US011591576B2

(12) United States Patent
Luginbuhl et al.

(10) Patent No.: US 11,591,576 B2
(45) Date of Patent: Feb. 28, 2023

(54) PROTEIN-BASED PURIFICATION MATRICES AND METHODS OF USING THE SAME

(71) Applicant: Isolere Bio, Inc., Durham, NC (US)

(72) Inventors: Kelli M. Luginbuhl, Durham, NC (US); Michael Dzuricky, Durham, NC (US)

(73) Assignee: Isolere Bio, Inc., Durham, NC (US)

( * ) Notice: Subject to any disclaimer, the term of this patent is extended or adjusted under 35 U.S.C. 154(b) by 0 days.

(21) Appl. No.: 17/493,938

(22) Filed: Oct. 5, 2021

(65) Prior Publication Data
US 2022/0010288 A1 Jan. 13, 2022

Related U.S. Application Data

(63) Continuation of application No. PCT/US2021/018805, filed on Feb. 19, 2021.

(60) Provisional application No. 62/978,615, filed on Feb. 19, 2020.

(51) Int. Cl.
*C07K 14/78* (2006.01)
*C07K 14/705* (2006.01)
*C07K 14/155* (2006.01)
*C07K 14/16* (2006.01)
*C07K 19/00* (2006.01)
*C12N 7/02* (2006.01)
*G01N 33/53* (2006.01)
*G01N 33/566* (2006.01)
*G01N 33/569* (2006.01)
*C12N 7/00* (2006.01)

(52) U.S. Cl.
CPC .............. *C12N 7/00* (2013.01); *C07K 14/155* (2013.01); *C07K 14/16* (2013.01); *C07K 14/705* (2013.01); *C07K 14/78* (2013.01); *C07K 19/00* (2013.01); *C12N 7/02* (2013.01); *G01N 33/53* (2013.01); *G01N 33/566* (2013.01); *G01N 33/56983* (2013.01); *C07K 2319/00* (2013.01); *C12N 2740/15011* (2013.01); *C12N 2740/15051* (2013.01)

(58) Field of Classification Search
CPC ...... C07K 14/78; C07K 14/705; C07K 14/15; C07K 14/155; C07K 14/16; C07K 19/00; C12Q 2600/158; C12Q 2600/136; C12Q 1/6886; C12Q 1/6809; C12Q 1/702; C12Q 1/6837; C12Q 1/6895; C12Q 2600/106; C12Q 1/025; C12Q 1/6883; C12Q 2600/118; C12Q 2600/156; C12Q 1/68; C12Q 1/6876
See application file for complete search history.

(56) References Cited

U.S. PATENT DOCUMENTS

| | | | |
|---|---|---|---|
| 6,582,926 B1 | 6/2003 | Chilkoti | |
| 9,616,138 B1 | 4/2017 | Iglesias et al. | |
| 10,385,115 B2 * | 8/2019 | Chilkoti | A61K 9/0019 |
| 10,633,662 B2 | 4/2020 | Pillay et al. | |
| 2005/0255554 A1 | 11/2005 | Chilkoti | |
| 2011/0039776 A1 * | 2/2011 | Chilkoti | A61P 3/10 |
| | | | 514/11.7 |
| 2012/0122153 A1 | 5/2012 | Bedzyk et al. | |
| 2018/0327752 A1 | 11/2018 | Pillay et al. | |
| 2019/0048039 A1 * | 2/2019 | Chen | C07K 14/78 |
| 2019/0282656 A1 | 9/2019 | Mackay et al. | |
| 2019/0328662 A1 | 10/2019 | Chilkoti et al. | |
| 2021/0261626 A1 | 8/2021 | Luginbuhl et al. | |
| 2021/0340186 A1 | 11/2021 | Luginbuhl et al. | |

FOREIGN PATENT DOCUMENTS

| | | |
|---|---|---|
| CN | 104725515 A | 6/2015 |
| CN | 105175554 A | 12/2015 |
| WO | WO-2006110292 A2 * | 10/2006 |
| WO | WO-2014026054 A2 * | 2/2014 |
| WO | WO 2016/154530 A1 | 9/2016 |
| WO | WO-2018057847 A1 * | 3/2018 |
| WO | WO 2020/037100 A1 | 2/2020 |
| WO | WO 2021/106882 A1 | 6/2021 |

OTHER PUBLICATIONS

Balu et al. Resilin-mimetics as a smart biomaterial platform for biomedical applications. Nature Comm 12: 149, 2021 (15 total pages).*
Bhattacharya et al. Impact of genetic variation on three dimensional structure and function of proteins. PLoS ONE 12(3): e0171355, 2017.*
Bork, P. Powers and pitfalls in sequence analysis: the 70% hurdle. Genome Res 10: 398-400, 2000.*
Bork, P. Go hunting in sequence databases but watch out for the traps. Trends in Genetics 12(10): 425-427, 1996.*
Brenner. S.E. Errors in genome annotation. Trends in Genetics 15:132-133, 1999.*
Doerks et al. Protein annotation: detective work for function prediction. Trends in Genetics 14:248-250, 1998.*
Dzuricky et al. De novo engineering of intracellular condensates using artificial disordered proteins. Nature Chem 12(9): 814-825, 2020.*
Dzuricky et al. Convergence of artificial protein polymers and intrinsically disordered proteins. Biochem 57: 2405-2414, 2018.*
Fenton et al. Rheostat positions: a new classification of protein positions relevant to pharmacogenomics. Medicinal Chem Res 29: 1133-1146, 2020.*

(Continued)

*Primary Examiner* — Bridget E Bunner
(74) *Attorney, Agent, or Firm* — Cooley LLP

(57) ABSTRACT

Provided herein are protein-based purification matrices and methods of use thereof to purify biologics and/or to remove contaminants from a composition. Methods of bringing two or more biologics in close proximity are also provided. The disclosed compositions and methods allow for faster, more efficient purification of a biologic compared to traditional affinity chromatography.

40 Claims, 28 Drawing Sheets

Specification includes a Sequence Listing.

(56) References Cited

OTHER PUBLICATIONS

Guo et al. Protein tolerance to random amino acid change. Proc Natl Acad Sci USA 101(25): 9205-9210, 2004.*
Huang et al. Silk-elastin-like protein biomaterials for the controlled delivery of therapeutics. Exp Opin Drug Delivery 12(5): 779-791, 2014.*
Kowalczyk et al. Elastin-like polypeptides as a promising family of genetically-engineered protein based polymers. World J Microbiol Biotechnol 30: 2141-2152, 2014.*
Kuna et al. Molecular size modulates pharmacokinetics, biodistribution, and renal deposition of the drug delivery biopolymer elastin-like polypeptide. Scientific Rep 8: 7923, 2018 (12 pages).*
MacEwan et al. Elastin-like polypeptides: biomedical applications of tunable biopolymers. Biopolymers (Pept Sci) 94(1): 60-77, 2010.*
Miller et al. Cell-surface receptors for retroviruses and implications for gene transfer. Proc Natl Acad Sci USA 93: 11407-11413, 1996.*
Ngo et al. "Computational complexity, protein structure prediction, and the Levinthal paradox" in The Protein Folding Problem and Tertiary Structure Prediction, pp. 492-495, 1994.*
Ohainle et al. A balancing act between primate lentiviruses and their receptor. Proc Natl Acad Sci USA 118(20): e2104741118, 2021.*
Roberts et al. Elastin-like polypeptides as models of intrinsically disordered proteins. FEBS Lett 589: 2477-2486, 2015.*
Skolnick et al. From genes to protein structure and function: novel applications of computational approaches in the genomic era. Trends Biotechnol 18(1):34-39 2000.*
Smith et al. The challenges of genome sequence annotation or "the devil is in the details". Nature Biotechnol 15: 1222-1223, 1997.*
Sommerfelt et al. Retrovirus receptors. J Gen Virol 80: 3049-3064, 1999.*
Tokuriki et al. Stability effects of mutations and protein evolvability. Curr Opin Structural Biol 19: 596-604, 2009.*
Wells, J.A. Additivity of mutational effects in proteins. Biochemistry 29(37): 8509-8517, 1990.*
Monfort and Koria. Recombinant elastin-based nanoparticles for targeted gene therapy. Gene Therapy 24: 610-620, 2017 (Final edited form).*
Christensen et al. Fusion order controls expression level and activity of elastin-like polypeptide fusion proteins. Protein Sci 18: 1377-1387, 2009.*
Hassaouneh et al. Fusions of elastin-like polypeptides to pharmaceutical proteins. Methods Enzymol 502: 215-237, 2012.*
Heider et al. Integrated method for purification and single-particle characterization of lentiviral vector systems by size exclusion chromatography and tunable resistive pulse sensing. Mol Biotechnol 59: 251-259, 2017.*
Merten et al. Production of lentiviral vectors. Mol Therapy Methods Clin Dev 3: 16017, 2016.*
Christensen et al., "Predicting Transition Temperatures of Elastin-Like Polypeptide Fusion Proteins," Biomacromolecules, 2013, vol. 14, No. 5, pp. 1514-1519.
Hassouneh et al., "Elastin-like Polypeptides as a Purification Tag for Recombinant Proteins," Curr Protoc Protein Sci. Aug. 2010; Chapter: Unit-6.11, 20 pages.
International Search Report and Written Opinion of the International Searching Authority for International Application No. PCT/US2019/046607 dated Nov. 29, 2019.
Monfort and Koria, "Recombinant elastin based nanoparticles for targeted gene therapy," Gene Ther. Oct. 2017; 24(10): 610-620.
Teschner et al., "rAAV for Tumor Therapy Using Transcriptional and Translational Control of Suicide Gene Expression Purified by a Newly Developed Affinity Chromatography Based on the PKD Domains of AAVR," Molecular Therapy, Pharmacology/Toxicology Studies, Abstract 970, vol. 28, No. 4S1, Apr. 28, 2020, p. 422.
Teschner, K. E., "Optimization of rAAV mediated targeted suicide gene therapy, rAAV manufacturing and downstream processing," Dissertation, Universität Bielefeld, 2019, 229 pages.
Uniprot Accession No. P01130 (Ldlr_Human), Jul. 21, 1986, 40 pages, retrieved from https://www.uniprot.org/uniprot/P01130.txt.
Yeboah et al., "Elastin-Like Polypeptides: A Strategic Fusion Partner for Biologies," Biotechnology and Bioengineering, Aug. 2016, vol. 113, No. 8, pp. 1617-1627.
Wu et al., "Single-step concentration and purification of adenoviruses by coxsackievirus-adenovirus receptor-binding capture and elastin-like polypeptide-mediated precipitation," Archives of Virology (2016) 161: 279-287.
International Search Report and Written Opinion of the International Searching Authority for International Application No. PCT/US2021/018805 dated Jul. 8, 2021, 13 pages.
International Search Report and Written Opinion of the International Searching Authority for International Application No. PCT/US2021/018812 dated Jul. 22, 2021, 14 pages.
Extended European Search Report for European Application No. 19850360.9 dated Apr. 20, 2022, 12 pages.
Guo et al., "Rapid and simplified purification of recombinant adeno-associated virus," Journal of Virological Methods (2012) 183, 139-146.
Kim et al., "Elastin-like polypeptide matrices for enhancing adeno-associated virus-mediated gene delivery to human neural stem cells," Gene Therapy, (2012) 19, 329-337.
Pillay et al., "Adeno-associated Virus (AAV) Serotypes Have Distinctive Interactions with Domains of the Cellular AAV Receptor," J. Virol (2017) 91:e00891-17, 17 pages.
Pillay et al., "An essential receptor for adeno-associated virus infection," Nature, Feb. 2016, vol. 530, pp. 108-112, 17 pages.

* cited by examiner

B1 Western blot confirms presence of capsid proteins in elution and depletion in capture supernatant CCH = cellular supernatant
Capture Sup = supernatant after purification matrix applied
Elution = purified AAV

PROTEIN-BASED PURIFICATION MATRICES AND METHODS OF USING THE SAME

CROSS-REFERENCE TO RELATED APPLICATIONS

This application is a continuation of International Patent Application No. PCT/US2021/018805, filed Feb. 19, 2021, which claims the benefit of priority to U.S. Provisional Application No. 62/978,615, filed Feb. 19, 2020, the contents of which are incorporated by reference herein in their entirety.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: ISOL_002_01US_SubSeqList_ST25.txt, date recorded: Feb. 28, 2022; file size: —1.40 megabyte).

FIELD

The present disclosure is generally related to compositions and methods for purification of biologics. More specifically, the present disclosure relates to protein-based purification matrices, and methods of using the same.

BACKGROUND

The use of biologics in medicine and other disciplines is rapidly increasing. Biologics often have high affinity and specificity for a given target, as well as low toxicity and biodegradability. However, their manufacturing and purification can be quite difficult. Biologics, including therapeutic enzymes, antibodies, gene delivery vectors, and other fusion proteins, are typically manufactured recombinantly in bacteria, yeast, or mammalian host cells. Numerous downstream purification steps are then required in order to meet acceptable standards of purity (e.g., standards set by the FDA or other regulatory bodies). Host cell proteins, nucleic acids, endotoxins, and viruses are often the main contaminants that must be removed from biologic preparations.

One commonly used method of purification is affinity chromatography. For example, during antibody manufacture, affinity capture with Protein A chromatography is often the first step after clarification of the cell culture harvest. While affinity chromatography achieves high levels of purity (>90%) due to its selectivity for the target biologic, it is expensive, time consuming, and requires technical equipment that is expensive to maintain and requires skilled labor. It is also difficult to scale because conditions are not linear as column diameters become large.

There is a need in the art for improved compositions and methods for rapidly and cost-effectively purifying biologics.

SUMMARY

The present disclosure provides protein-based purification matrices for purifying biologics, and methods for using the same.

In some embodiments, the disclosure provides a method for purifying a biologic, the method comprising contacting the biologic with a protein-based purification matrix; wherein the biologic binds to the purification matrix to form a complex; wherein the size of the complex is increased by a first environmental factor; wherein the complex is separated from at least one contaminant on the basis of size; and wherein the biologic is separated from the purification matrix by a second environmental factor.

In some embodiments, the disclosure provides a method for removing a contaminant from a composition comprising a biologic, the method comprising contacting the contaminant with a protein-based purification matrix; wherein the contaminant binds to the matrix to form a complex; wherein the size of the complex is increased by a first environmental factor; wherein the complex is separated from the biologic on the basis of size; and wherein the contaminant is separated from the matrix by a second environmental factor.

In some embodiments, the disclosure provides a method for purifying a biologic, the method comprising contacting the biologic with a protein-based purification matrix; wherein the biologic binds to the matrix to form a complex; wherein the size of the complex is increased; wherein the complex is separated from at least one contaminant on the basis of size; and wherein the biologic is separated from the matrix by an environmental factor.

In some embodiments, the disclosure provides a method for separating a first biologic from a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

In some embodiments, the disclosure provides a method of bringing a first biologic into proximity with a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and wherein an environmental factor brings the first complex and the second complex into proximity with one another.

In some embodiments, the purification matrices described herein comprise (i) a capture domain which binds to the biologic, and (ii) a polypeptide with phase behavior, wherein the capture domain is coupled to the polypeptide with phase behavior. In some embodiments, the purification matrices comprise (i) a capture domain which binds to the contaminant, and (ii) a polypeptide with phase behavior, wherein the capture domain is coupled to the polypeptide with phase behavior.

In some embodiments, the capture domain is coupled to the polypeptide with phase behavior via a linker. In some embodiments, the linker is a peptide linker. In some embodiments, the peptide linker comprises a protease cleavage site. In some embodiments, the linker is a chemical linker.

In some embodiments, the purification matrix comprises a fusion protein comprising (i) a capture domain which binds to the biologic and (ii) a polypeptide with phase behavior. In some embodiments, the purification matrix comprises a fusion protein comprising (i) a capture domain which binds to the contaminant and (ii) a polypeptide with phase behavior.

In some embodiments, the polypeptide with phase behavior is a resilin-like polypeptide.

In some embodiments, the polypeptide with phase behavior is an elastin-like polypeptide.

In some embodiments, the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline. In some embodiments, n is an integer from 1 to 360, inclusive of endpoints.

In some embodiments, the polypeptide with phase behavior comprises an amino acid sequence selected from: (GRGDSPY)$_n$ (SEQ ID NO: 1); (GRGDSPH)$_n$ (SEQ ID NO: 2); (GRGDSPV)$_n$ (SEQ ID NO: 3); (GRGDSPYG)$_n$ (SEQ ID NO: 4); (RPLGYDS)$_n$ (SEQ ID NO: 5); (RPAGYDS)$_n$ (SEQ ID NO: 6); (GRGDSYP)$_n$ (SEQ ID NO: 7); (GRGDSPYQ)$_n$ (SEQ ID NO: 8); (GRGNSPYG)$_n$ (SEQ ID NO: 9); (GVGVP)$_n$ (SEQ ID NO: 11); (GVGVPGLGVPGVGVPGLGVPGVGVP)$_m$ (SEQ ID NO: 12); (GVGVPGVGVPGAGVPGVGVPGVGVP)$_m$ (SEQ ID NO: 13); (GVGVPGWGVPGVGVPGWGVPGVGVP)$_m$ (SEQ ID NO: 14); (GVGVPGVGVPGVGVPGVGV PGVGVP GVGVPGEGVPGFGVPGVGVP)$_m$ (SEQ ID NO: 15); (GVGVPGVGVPGVGVPGVGVPGVGVPGVGVPGKG-VPGFGVPGVGVP)$_m$ (SEQ ID NO: 16); and (GAGVPGVGVPGAGVPGVGVPGAGVP)$_m$ (SEQ ID NO: 17); or a randomized, scrambled analog thereof; wherein: n is 20-360; and m is 4-25. In some embodiments, the he polypeptide with phase behavior comprises an amino acid sequence selected from: (GVGVP)$_m$ (SEQ ID NO: 52); (ZZPXXXXGZ)$_m$ (SEQ ID NO: 57); (ZZPXGZ)$_m$ (SEQ ID NO: 58); (ZZPXXGZ)$_m$ (SEQ ID NO: 59); or (ZZPXXXGZ)$_m$ (SEQ ID NO: 60); wherein m is an integer between 10 and 160, inclusive of endpoints, wherein X if present is any amino acid except proline or glycine, and wherein Z if present is any amino acid. In some embodiments, the polypeptide with phase behavior comprises an amino acid sequence of (GVGVPGVGVPGAGVPGV GVPGVGVP)$_m$ (SEQ ID NO: 53) or (GVGVPGVGVPG LGVPGVGVPGVGVP)$_m$ (SEQ ID NO: 55); wherein m is an integer between 2 and 32, inclusive of endpoints. In some embodiments, the polypeptide with phase behavior comprises an amino acid sequence selected from: (GVGVPGVGVPGAGVPGVGVPGVGVP)$_m$ (SEQ ID NO: 193), wherein m is 8 or 16; (GVGVPGAGVP)$_m$ (SEQ ID NO: 54), wherein m is an integer between 5 and 80, inclusive of endpoints; or (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

In some embodiments, the capture domain comprises the sequence of any one of SEQ ID NO: 24-49, 62-148, and 167-171, or a sequence having at least 1, at least 2, at least 3, at least 4, or at least 5 mutations relative thereto.

In some embodiments, the binding of a biologic to the purification matrix is reversible. In some embodiments, the binding of a biologic to the purification matrix is non-covalent. In some embodiments, the binding of a biologic to the purification matrix is covalent.

In some embodiments, the binding of a contaminant to the purification matrix is reversible. In some embodiments, the binding of a contaminant to the purification matrix is non-covalent. In some embodiments, the binding of a contaminant to the purification matrix is covalent.

In some embodiments, the biologic is a lipid, a lipopolysaccharide, a cell, a protein, a nucleic acid, a carbohydrate, or a virus.

In some embodiments, the biologic is a cell. In some embodiments, the cell is a bacterial cell, a yeast cell, or a mammalian cell. In some embodiments, the cell is a stem cell, a bone cell, a blood cell, a muscle cell, a fat cell, a skin cell, a nerve cell, an endothelial cell, a sex cell, a pancreatic cell, or a cancer cell. In some embodiments, the cell is an immune cell. In some embodiments, the immune cell is a T cell, a B cell, a NK cell, a peripheral blood mononuclear cell, or a neutrophil. In some embodiments, the cell is a T cell expressing a chimeric antigen receptor (CAR).

In some embodiments, the nucleic acid is a DNA or an RNA.

In some embodiments, the virus is an adenovirus, an adeno-associated virus (AAV), a lentivirus, a retrovirus, a poxvirus or a herpesvirus.

In some embodiments, the biologic has a diameter between 1 nm and 100 μm, inclusive of the endpoints. In some embodiments, the biologic has a diameter between 1 nm and 100 nm, inclusive of the endpoints. In some embodiments, the biologic has a diameter between 100 nm and 1 μm, inclusive of the endpoints. In some embodiments, the biologic has a diameter between 1 μm and 50 μm, inclusive of the endpoints. In some embodiments, the biologic has a diameter between 50 μm and 100 μm, inclusive of the endpoints.

In some embodiments, the methods of the disclosure are completed in about 0.5 hours to about 24 hours. In some embodiments, the methods of the disclosure are completed in about 0.5 hours to about 8 hours. In some embodiments, the methods of the disclosure are completed in about 2 hours to about 6 hours.

In some embodiments, the separation of the complex from the at least one contaminant can be observed visually with an unaided eye.

In some embodiments, the increase in size of the complex is at least a 2-fold increase. In some embodiments, the increase in size of the complex is at least a 10-fold increase. In some embodiments, the increase in size of the complex is at least a 25-fold increase. In some embodiments, the increase in size is an increase in the mass of the complex. In some embodiments, the increase in size is an increase in the diameter of the complex.

In some embodiments, the environmental factor comprises one or more of: a change in one or more of temperature, pH, salt concentration, concentration of the purification matrix, concentration of the biologic, or pressure; the addition of one or more surfactants, molecular crowding agents, reducing agents, oxidizing agents, enzymes, or denaturing agents; or the application of electromagnetic or acoustic waves. In some embodiments, the environmental factor is the first and/or second environmental factor.

In some embodiments, the separation on the basis of size is performed using tangential flow filtration, membrane chromatography, analytical ultracentrifugation, high performance liquid chromatography, membrane chromatography, and/or fast protein liquid chromatography.

In some embodiments, the contaminant is selected from a solvent, an endotoxin, a protein, a peptide, a nucleic acid, and a carbohydrate.

In some embodiments, the purification yield of the biologic is at least 70%, at least 80%, at least 90%, at least 95%, at least 96%, at least 97%, at least 98%, or at least 99%. In some embodiments, the biologic is purified to at least 70%, at least 80%, at least 90%, at least 95%, at least 96%, at least 97%, at least 98%, or at least 99% purity.

In some embodiments, provided herein is a method of increasing yield of a biologic during production thereof, the method comprising culturing biologic-producing cells in the presence of a purification matrix. In some embodiments, the biologic reversibly binds to the purification matrix to form a complex. In some embodiments, the purification matrix is present at a concentration of at least about 10 μM.

In some embodiments, provided herein is a method of stabilizing a biologic during production thereof, the method comprising culturing biologic-producing cells in the presence of a purification matrix. In some embodiments, the biologic reversibly binds to the purification matrix to form a complex. In some embodiments, the purification matrix is present at a concentration of at least about 10 μM.

In some embodiments, provided herein is a method of stabilizing a biologic during purification thereof, the method comprising contacting the biologic with a purification matrix during purification thereof. In some embodiments, the biologic reversibly binds to the purification matrix to form a complex. In some embodiments, the purification matrix is present at a concentration of at least about 10 μM.

In some embodiments, provided herein is a method of stabilizing a biologic during storage thereof, the method comprising storing the biologic in the presence of a purification matrix.

In some embodiments, provided herein is a method of increasing the shelf-life of a biologic, the method comprising storing the biologic in the presence of a purification matrix. In some embodiments, the biologic reversibly binds to the purification matrix to form a complex. In some embodiments, the purification matrix is present at a concentration of at least about 10 μM.

These and other embodiments will be further described below in the Detailed Description, Examples, and Claims.

DETAILED DESCRIPTION OF THE INVENTION

Definitions

Figure 1:
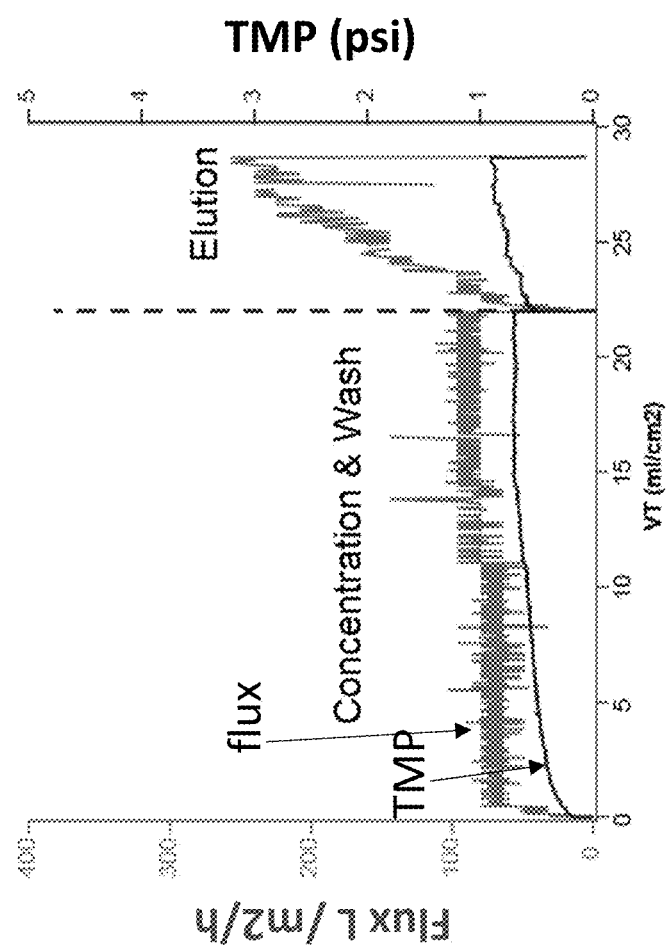
FIG. 1 is a graph that shows the tangential flow filtration flux and transmembrane pressure during the separation of an AAV9-purification matrix complex from impurities. The purification matrix can efficiently purify AAV9 particles with tangential flow filtration (TFF) in oncentration-diafiltration-concentration-diafiltration (CDCD) mode. The process is performed at high flux and with a low and stable transmembrane pressure (TMP) in permeate-control mode.

As used herein, and in the appended claims, the singular forms "a", "an", and "the" include plural referents unless the context clearly dictates otherwise. Thus, for example, reference to "a protein" can refer to one protein or to mixtures of such protein, and reference to "the method" includes reference to equivalent steps and/or methods known to those skilled in the art, and so forth.

As used herein, the term "about" or "approximately" when preceding a numerical value indicates the value plus or minus a range of 10%. For example, "about 100" encompasses 90 and 110.

Also as used herein, "and/or" refers to and encompasses any and all possible combinations of one or more of the associated listed items, as well as the lack of combinations when interpreted in the alternative ("or").

Unless the context indicates otherwise, it is specifically intended that the various features described herein can be used in any combination.

Moreover, the present disclosure also contemplates that in some embodiments, any feature or combination of features set forth herein can be excluded or omitted. To illustrate further, if, for example, the specification indicates that a particular amino acid can be selected from A, G, I, L and/or V, this language also indicates that the amino acid can be selected from any subset of these amino acid(s) for example A, G, I or L; A, G, I or V; A or G; only L; etc., as if each such subcombination is expressly set forth herein. Moreover, such language also indicates that one or more of the specified amino acids can be disclaimed. For example, in particular embodiments the amino acid is not A, G or I; is not A; is not G or V; etc., as if each such possible disclaimer is expressly set forth herein.

As used herein, the term "protein-based" refers to a composition that comprises a protein or peptide component. For example, a protein-based purification matrix is a purification matrix that comprises a protein or peptide.

As used herein, the term "environmental factor" is any factor that, when applied to a composition comprising a protein-based purification matrix, alters one or more properties of the composition. Non-limiting examples of environmental factors include a change in one or more of temperature, pH, salt concentration, concentration of the purification matrix, concentration of the biologic, or pressure; the addition of one or more surfactants, molecular crowding agents, denaturing agents, reducing agents, or oxidizing agents; or the application of electromagnetic or acoustic waves.

As used herein, the term "biologic" may refer to, for example, a protein, a peptide, a carbohydrate, a nucleic acid, a virus, a cell (e.g., a bacterial, yeast, or mammalian cell), a carbohydrate, a lipid, or a lipopolysaccharide.

As used herein, the term "contaminant" may refer to any substance that is not desired in a purified composition. In some embodiments, the contaminant is any substance other than the biologic desired to be purified. Non-limiting examples of contaminants include, but are not limited to, a solvent, a protein, a peptide, a carbohydrate, a nucleic acid, a virus, a cell (e.g., a bacterial, yeast, or mammalian cell), a carbohydrate, a lipid, or a lipopolysaccharide. In some embodiments, the contaminant is an endotoxin or a mycotoxin.

An "adeno-associated virus" (AAV) is a small, replication-deficient parvovirus. As used herein, AAV may refer to a wildtype or mutant AAV of any one of the following serotypes: AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, and any other AAV now known or later discovered. In some embodiments, an AAV may have a single-stranded genome, or a double-stranded genome (e.g., a self-complementary AAV). The "capsid" of an AAV particle is a near-spherical protein shell that comprises individual "capsid protein subunits" or "capsid proteins" (e.g., about 60 capsid protein subunits) associated and arranged with T=1 icosahedral symmetry. Accordingly, the capsids of the AAV vectors described herein comprise a plurality of capsid proteins. An "AAV particle" typically comprises a capsid, and a nucleic acid (e.g., a nucleic acid comprising a transgene) encapsidated by the protein capsid. When an AAV particle is described as comprising a capsid protein, it will be understood that the AAV particle comprises a capsid, wherein the capsid comprises one or more AAV capsid proteins. When an AAV particle is described as binding to a binding domain, it will be understood that the binding domain may bind to one or more capsid proteins within the capsid. The term "empty AAV particle" or "empty capsid" refers to an AAV particle or capsid that does not comprise any vector genome or nucleic acid comprising an expression cassette or transgene.

A "viral particle" typically comprises a protein shell (e.g., a capsid or an envelope), and a nucleic acid (e.g., a nucleic acid comprising a transgene) contained therein.

As used herein, the terms "peptide," "polypeptide," and "protein" are used interchangeably, and refer to a compound comprised of amino acid residues covalently linked by peptide bonds. A protein must contain at least two amino acids, and no limitation is placed on the maximum number of amino acids that can comprise a protein's sequence. The term "peptide" may refer to a short chain of amino acids including, for example, natural peptides, recombinant peptides, synthetic peptides, or a combination thereof. Proteins and peptides may include, for example, biologically active fragments, substantially homologous polypeptides, oligopeptides, homodimers, heterodimers, variants of polypeptides, modified polypeptides, derivatives, analogs, and fusion proteins, among others.

A "polynucleotide" is a sequence of nucleotide bases, and may be RNA, DNA or DNA-RNA hybrid sequences (including both naturally occurring and/or non-naturally occurring nucleotides). In some embodiments, a polynucleotide is either a single or double stranded DNA sequence.

As used herein, by "isolate" or "purify" (or grammatical equivalents) a biologic, it is meant that the biologic is at least partially separated from at least some of the other components in a starting material comprising the biologic (e.g., a cell lysate). In representative embodiments an "isolated" or "purified" biologic is enriched by at least about 10-fold, about 100-fold, about 1000-fold, about 10,000-fold or more as compared with the starting material.

As used herein, the term "polypeptide with phase behavior" refers to any polypeptide that is capable of undergoing a phase transition. In some embodiments, the polypeptide undergoes a phase transition due to the application of an environmental factor. Exemplary polypeptides with phase behavior include elastin-like polypeptides (ELPs) and resilin-like polypeptides (RLPs).

As used herein, the term "fusion protein" refers to a polypeptide produced when two heterologous nucleotide sequences or fragments thereof coding for two (or more) different polypeptides not found fused together in nature are fused together in the correct translational reading frame.

As used herein, the term "capture domain" may refer to any amino acid sequence (protein, peptide, etc.) which binds to a target biologic. In some embodiments, the capture domain may comprise a full-length, truncated, or modified version of a receptor for the target biologic. In some embodiments, the capture domain may be an antigen-binding portion of a monoclonal antibody (e.g., a Fab), a single-chain variable fragment (scFv) derived from a monoclonal antibody; a natural ligand of the target biologic; a peptide with sufficient affinity for the target; a single domain binder such as a camelid; an artificial binder such as a Darpin; or a single-chain derived from a T-cell receptor.

As used herein, the term "fragment" as it refers to a protein or polypeptide includes a truncated form of the protein or polypeptide. For example, a fragment of CD4 may include about 1%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 97%, or about 99% of the amino acids of full-length CD4.

As used herein, the term "capture efficiency" as it relates to a purification matrix described herein refers to the amount of biologic captured by a purification matrix relative to the amount of biologic present in the starting composition. The following equation is used to determine capture efficiency: 100×(amount of biologic captured by the purification matrix/amount of biologic in the composition before purification).

As used herein, the term "amino acid" encompasses any naturally occurring amino acid, modified forms thereof, and synthetic amino acids. Naturally occurring, levorotatory (L-) amino acids are shown in Table 1.

TABLE 1

Amino acid residues and abbreviations.

| Amino Acid Residue | Abbreviation | |
|---|---|---|
| | Three-Letter Code | One-Letter Code |
| Alanine | Ala | A |
| Arginine | Arg | R |
| Asparagine | Asn | N |
| Aspartic acid (Aspartate) | Asp | D |
| Cysteine | Cys | C |
| Glutamine | Gln | Q |
| Glutamic acid (Glutamate) | Glu | E |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

Alternatively, the amino acid can be a modified amino acid residue (nonlimiting examples are shown in Table 2) and/or can be an amino acid that is modified by post-translational modification (e.g., acetylation, amidation, formylation, hydroxylation, methylation, phosphorylation or sulfatation).

TABLE 2

Modified Amino Acid Residues.

| Modified Amino Acid Residue Amino Acid Residue Derivatives | Abbreviation |
|---|---|
| 2-Aminoadipic acid | Aad |
| 3-Aminoadipic acid | bAad |
| beta-Alanine, beta-Aminoproprionic acid | bAla |
| 2-Aminobutyric acid | Abu |
| 4-Aminobutyric acid, Piperidinic acid | 4Abu |
| 6-Aminocaproic acid | Acp |
| 2-Aminoheptanoic acid | Ahe |
| 2-Aminoisobutyric acid | Aib |
| 3-Aminoisobutyric acid | bAib |
| 2-Aminopimelic acid | Apm |
| t-butylalanine | t-BuA |
| Citrulline | Cit |
| Cyclohexylalanine | Cha |
| 2,4-Diaminobutyric acid | Dbu |
| Desmosine | Des |
| 2,21-Diaminopimelic acid | Dpm |

TABLE 2-continued

Modified Amino Acid Residues.

| Modified Amino Acid Residue Amino Acid Residue Derivatives | Abbreviation |
|---|---|
| 2,3-Diaminoproprionic acid | Dpr |
| N-Ethylglycine | EtGly |
| N-Ethylasparagine | EtAsn |
| Homoarginine | hArg |
| Homocysteine | hCys |
| Homoserine | hSer |
| Hydroxylysine | Hyl |
| Allo-Hydroxylysine | aHyl |
| 3-Hydroxyproline | 3Hyp |
| 4-Hydroxyproline | 4Hyp |
| Isodesmosine | Ide |
| allo-Isoleucine | aIle |
| Methionine sulfoxide | MSO |
| N-Methylglycine, sarcosine | MeGly |
| N-Methyl isoleucine | MeIte |
| 6-N-Methyllysine | MeLys |
| N-Methylvaline | MeVal |
| 2-Naphthylalanine | 2-Nal |
| Norvaline | Nva |
| Norleucine | Nle |
| Ornithine | Orn |
| 4-Chlorophenylalanine | Phe(4-Cl) |
| 2-Fluorophenylalanine | Phe(2-F) |
| 3-Fluorophenylalanine | Phe(3-F) |
| 4-Fluorophenylalanine | Phe(4-F) |
| Phenylglycine | Phg |
| Beta-2-thienylalanine | Thi |

Further, the non-naturally occurring amino acid can be an "unnatural" amino acid (as described by Wang et al., Annu Rev Biophys Biomol Struct. 35:225-49 (2006)).

Methods of Using Protein-Based Purification Matrices

The disclosure provides protein-based purification matrices and methods of using the same. In some embodiments, the protein-based purification matrices comprise a capture domain which binds to a target and a polypeptide with phase behavior, wherein the capture domain is coupled to the polypeptide with phase behavior. Non-limiting examples of targets include biologics and contaminants.

In some embodiments, a method of purifying a biologic comprises contacting the biologic with a protein-based purification matrix; wherein the biologic binds to the purification matrix to form a complex; wherein the size of the complex is increased by a first environmental factor; wherein the complex is separated from at least one contaminant on the basis of size; and wherein the biologic is separated from the purification matrix by a second environmental factor.

In some embodiments, a method of purifying a biologic comprises contacting the biologic with a protein-based purification matrix; wherein the biologic binds to the matrix to form a complex; wherein the size of the complex is increased; wherein the complex is separated from at least one contaminant on the basis of size; and wherein the biologic is separated from the matrix by an environmental factor.

In some embodiments, a method of removing a contaminant from a composition comprising a biologic comprises contacting the contaminant with a protein-based purification matrix; wherein the contaminant binds to the matrix to form a complex; wherein the size of the complex is increased by a first environmental factor; wherein the complex is separated from the biologic on the basis of size; and wherein the contaminant is separated from the matrix by a second environmental factor.

In some embodiments, a method of separating a first biologic from a second biologic comprises contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

Also provided herein is a method of bringing a biologic in proximity to another biologic or small molecule. In some embodiments, a method of bringing a first biologic into proximity with a second biologic comprises contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and wherein an environmental factor brings the first complex and second complex into proximity with one another. In some embodiments, a method of bringing a first biologic into proximity with another molecule comprises contacting the first biologic with a first protein-based purification matrix and contacting the molecule with a second protein-based purification matrix; wherein the first biologic binds to the first purification matrix to form a first complex; wherein the molecule binds to the second purification matrix to form a second complex; and wherein an environmental factor brings the first complex and second complex into proximity with one another. In some embodiments, the methods described herein bring a first biologic and a second biologic within about 10 µm, about 5 µm, about 1 µm, about 900 nm, about 800 nm, about 700 nm, about 600 nm, about 500 nm, about 400 nm, about 300 nm, about 200 nm, about 100 nm, about 10 nm, about 1 nm, about 0.5 nm, or about 0.1 nm of one another. In some embodiments, a first biologic and a second biologic are brought into proximity with one another, wherein the first biologic is an enzyme and the second biologic is a substrate thereof.

In some embodiments, the methods described herein utilize a protein-based purification matrix comprising a capture domain and a polypeptide with phase behavior. In some embodiments, the methods described herein utilize two or more distinct protein-based purification matrices.

In some embodiments, the methods described herein involve the formation of a complex. In some embodiments, the methods described herein involve the formation of one or more complexes. In some embodiments, the methods described herein involve the formation of one, two, three, four, five, or more complexes. The complexes may be referred to as "first complex" or "second complex," and so on.

In some embodiments, a complex comprises a protein-based purification matrix and a biologic. In some embodiments, a complex comprises a protein-based purification matrix and a contaminant. In some embodiments, a complex comprises a protein-based purification matrix and a second protein such as an enzyme substrate, a metabolite, a ligand (e.g., a ligand that binds to a cellular receptor).

In some embodiments, the components of the complex (e.g. the purification matrix and the contaminant, biologic, and/or other molecule) bind to each other. In some embodiments, the binding is reversible. Reversible binding means that the complexes can dissociate e.g. separate into individual components. For example, if a complex reversibly forms between the purification matrix and a biologic, the purification matrix and the biologic can subsequently disassociate. In some embodiments, dissociation is triggered by an environmental factor. In some embodiments, reversible binding allows for separation of a biologic from the purification matrix. In some embodiments, reversible binding allows for separation of a contaminant from the purification matrix. In some embodiments, reversible binding allows for separation of the other molecule from the purification matrix.

In some embodiments, reversible binding is non-covalent, i.e. no covalent bonds are formed between the interacting components of the complex (such as between the purification matrix and the contaminant, biologic, and/or other molecule). In some embodiments, non-covalent interactions cause the purification matrix and the contaminant, biologic, and/or other molecule to bind to each other. Non-limiting examples of non-covalent interactions include dipole-dipole forces, van der Waals forces, London Dispersion forces, hydrogen bonding, hydrophobic interactions, and electrostatic interactions. In some embodiments, non-covalent binding is disrupted by the addition of an environmental factor.

In some embodiments, binding between the purification matrix and a target molecule (e.g., a contaminant, biologic, and/or other molecule) is covalent. In some embodiments, a covalent bond between a purification and a matrix may be cleaved using, for example, a protease.

In some embodiments, the size of the complexes described herein increase after an environmental factor is applied. In some embodiments, the size of a complex formed between the purification matrix and biologic, contaminant, and/or other molecule increases. In some embodiments, the size of the initial complex increases as a result of aggregation of multiple complexes. In some embodiments, multiple complexes aggregate due to self-assembly of protein-based purification matrices. In some embodiments, multiple complexes aggregate due to the application of an environmental factor. In some embodiments, the size increase is stabilized by non-covalent interactions between multiple protein-based purification matrix molecules. In some embodiments, the size increase is stabilized by non-covalent interactions between the polypeptides with phase behavior. In some embodiments, the non-covalent interactions are dipole-dipole forces, van der Waals forces, London Dispersion forces, hydrogen bonding, hydrophobic interactions, and/or electrostatic interactions.

In some embodiments, the methods of the disclosure provide for the formation of multiple complexes in a mixture. In some embodiments, the size of all of complexes increase. In some embodiments, the size of some complexes increases, and the size of the other complexes remains constant. In some embodiments, the size of one complex increases, and the size of the other complex remains constant.

In some embodiments, the size of the initial complex increases by at least about 2-fold, at least about 5-fold, at least about 10-fold, at least about 15-fold, at least about 20-fold, at least about 25-fold, at least about 30-fold, at least about 35-fold, at least about 40-fold, at least about 45-fold, at least about 50-fold, at least about 55-fold, at least about 60-fold, at least about 65-fold, at least about 70-fold, at least about 75-fold, at least about 80-fold, at least about 85-fold, at least about 90-fold, at least about 95-fold, at least about 100-fold, or more. In some embodiments, the size of the initial complex increases by at least about 2-fold. In some embodiments, the size of the initial complex increases by at least about 5-fold. In some embodiments, the size of the initial complex increases by at least about 10-fold. In some embodiments, the size of the initial complex increases by at least about 25-fold.

As used herein, the phrase "increase in size" may refer to an increase in the diameter of the complex or an increase in the mass of the complex. In some embodiments, the increase in size is an increase in the molar mass of the complex. In some embodiments, the increase in size is an increase in the hydrodynamic radius of the complex.

In some embodiments, the increase in size of the complex can be observed visually with an unaided eye. For example, the increase in size of the complex may cause a composition comprising the complex to change color, clarity, viscosity, and/or may cause the complex to change solubility (e.g., to precipitate from solution), wherein such change is observable by a human without the use of any special equipment.

In some embodiments, a person of skill in the art may measure the increase in the size of the complex according to known methods in the art. In some embodiments, the increase in the size of the complex can be measured utilizing a technique selected from the group consisting of x-ray scattering, small angle x-ray scattering, wide angle x-ray scattering, dynamic light scattering, analytical ultracentrifugation, size exclusion chromatography, and photon correlation spectroscopy.

In some embodiments, the complex of increased size is separated from a biologic, contaminant, and/or small molecule. In some embodiments, the complex of increased size containing a biologic and a protein-based purification matrix is separated from a contaminant. In some embodiments, the complex of increased size containing a contaminant and a protein-based purification matrix is separated from a composition containing a biologic. In some embodiments, the first complex of increased size containing a first biologic and a first protein-based purification matrix is separated from a second complex containing a second biologic and a second protein-based purification matrix.

In some embodiments, separation of the complex from the biologic, contaminant, and/or small molecule can be observed visually with an unaided eye.

In some embodiments, separation of the complex from the biologic, contaminant, and/or small molecule is on the basis of size. In some embodiments, the separation on the basis of size is performed using a technique selected from the group consisting of tangential flow filtration (TFF), analytical ultracentrifugation, membrane chromatography, high performance liquid chromatography, size exclusion chromatography, membrane chromatography, normal flow filtration, acoustic wave separation, centrifugation, counterflow centrifugation, and fast protein liquid chromatography. In some embodiments, the complex is separated from at least one impurity on the basis of size using tangential flow filtration. In some embodiments, the complex is separated from at least one impurity on the basis of size using centrifugation. In some embodiments, between about 100 relative centrifugal force (RCF) and about 16,000 RCF, for example, about 500 to about 16,000 RCF, about 1,000 RCF to 16,000 RCF, are applied to separate the complex from at least one impurity. In some embodiments, at least 500 relative centrifugal force (RCF) are applied to separate the complex from at least one impurity, for example, at least about 500 RCF, at least about 600 RCF, at least about 700 RCF, at least about 800 RCF, at least about 900 RCF, at least about 1000 RCF, at least about 2000 RCF, at least about 3000 RCF, at least about 3500 RCF, at least about 4000 RCF, at least about 5000 RCF, at least about 6000 RCF, at least about 7000 RCF, at least about 8000 RCF, at least about 9000 RCF, at least about 10,000 RCF, at least about 11,000 RCF, at least about 12,000 RCF, at least about 13,000 RCF, at least about 14,000 RCF, at least about 15,000 RCF, at least about 16,000 RCF, at least about 17,000 RCF, at least about 18,000 RCF, at least about 19,000 RCF, or at least about 20,000 RCF.

In some embodiments, separation of the complex from the biologic, contaminant, and/or small molecule on the basis of size is performed using TFF. In some embodiments, TFF may be used to separate the complex from at least one impurity on the basis of size, a process also referred to herein as "diafiltration." Diafiltration comprises both washing and elution steps. Washing removes impurities contained in the composition comprising the complexes. Elution separates purified biologics from the purification matrix. In some embodiments, the complexes are concentrated using TFF. In some embodiments, TFF may be used to increase the concentration of a complex within a composition, a process also referred to herein as "concentration."

Tangential flow filtration employs both microfiltration and ultrafiltration membranes to separate molecules. Microfiltration membranes typically have pore sizes between 0.1 µm and 10 µm. Ultrafiltration membranes typically have smaller pore sizes than microfiltration membranes with pore sizes between 0.001 µm and 0.1 µm. In some embodiments, a membrane with a pore size between about 0.001 µm and about 10 µm is utilized in the methods of the disclosure. In some embodiments, the membrane has a pore size of about 0.001 µm, about 0.01 µm, about 0.05 µm, about 0.1 µm, about 0.2 µm, about 0.3 µm, about 0.4 µm, about 0.5 µm, about 0.6 µm, about 0.7 µm, about 0.8 µm, about 0.9 µm, about 1.0 µm, about 2 µm, about 3 µm, about 4 µm, about 5 µm, about 6 µm, about 7 µm, about 8 µm, about 9 µm, or about 10 µm, including all values and ranges in between thereof. In some embodiments, the membrane has a pore size of about 0.1 µm. In some embodiments, the membrane has a pore size of about 0.2 µm.

In some embodiments, the membrane is made of hydrophilized poly(vinylildene difluoride) (PVDF), polyethersulfone (PES), cellulose phosphate, diethylaminoethyl cellulose, polysufone, regenerated cellulose, nylon, cellulose nitrate, cellulose acetate, pegylated PES, modified polyethersulfone, and sulfonated PES, or modified derivatives thereof of the aforementioned materials.

In TFF, a membrane is placed tangentially to the flow of a fluid mixture to cause the fluid mixture to flow tangentially over a first side of the membrane. At the same time, a fluid media is placed in contact with a second surface of the membrane. A transmembrane pressure is the force that drives fluid through the membrane, carrying along permeable molecules.

In some embodiments, separation of the complex from the biologic, contaminant, and/or small molecule on the basis of size is performed using TFF with a transmembrane pressure of between about 0.1 bar to about 3 bar. In some embodiments, the transmembrane pressure is about 0.1 bar, about 0.2 bar, about 0.3 bar, about 0.4 bar, about 0.5 bar, about 0.6 bar, about 0.7 bar, about 0.8 bar, about 0.9 bar, about 1.0 bar, about 1.1 bar, about 1.2 bar, about 1.3 bar, about 1.4 bar, about 1.5 bar, about 1.6 bar, about 1.7 bar, about 1.8 bar, about 1.9 bar, about 2.0 bar, about 2.1 bar, about 2.2 bar, about 2.3 bar, about 2.4 bar, about 2.5 bar, about 2.6 bar, about 2.7 bar, about 2.8 bar, about 2.9 bar, or about 3.0 bar, including all values and ranges in between. In some embodiments, the transmembrane pressure is about 1.5 bar.

In some embodiments, the cross flow rate is tuned to improve the separation of the complexes described herein from the biologic, contaminant, and/or small molecule. The cross flow rate is the rate of solution flow through the feed channel and across the membrane. It provides the force that sweeps away molecules that can restrict filtrate flow. In some embodiments, the cross flow rate is between about 500 L/m²/h and about 2000 L/m²/h. In some embodiments, the cross flow rate is between about 500 L/m²/h, about 600 L/m²/h, about 700 L/m²/h, about 800 L/m²/h, about 900 L/m²/h, about 1000 L/m²/h, about 1100 L/m²/h, about 1200 L/m²/h, about 1300 L/m²/h, about 1400 L/m²/h, about 1500 L/m²/h, about 1600 L/m²/h, about 1700 L/m²/h, about 1800 L/m²/h, about 1900 L/m²/h, or about 2000 L/m²/h, including all values and ranges in between thereof. In some embodiments, the cross flow rate is about 960 L/m²/h. In some embodiments, TFF separation occurs by using a membrane that retains the complex containing the purification matrix and the biologic while passing the contaminant. In some embodiments, a membrane that retains the complex containing the purification matrix and the contaminant while passing the biologic is used.

In some embodiments, a membrane that retains the complex containing the purification matrix and the contaminant while passing the biologic is utilized. In some embodiments, a membrane that retains the first complex containing the purification matrix and the first biologic while passing the complex containing the second purification matrix and second biologic is utilized.

In some embodiments, the methods described herein enable the purification of at least 0.1 kg, at least about 0.2 kg, at least about 0.3 kg, at least about 0.4 kg, at least about 0.5 kg, at least about 0.6 kg, at least about 0.7 kg, at least about 0.8 kg, at least about 0.9 kg, at least about 1 kg, at least about 2 kg, at least about 3 kg, at least about 4 kg, at least about 5 kg, at least about 6 kg, at least about 7 kg, at least about 8 kg, at least about 9 kg, at least about 10 kg, or more of biologic per day, including all values and ranges in between.

In some embodiments, the methods described herein are completed in about 0.5 hr to about 24 hours. In some embodiments, the methods are completed in about 0.5 hr, about 1 hr, about 2 hr, about 3 hr, about 4 hr, about 5 hr, about 6 hr, about 7 hr, about 8 hr, about 9 hr, about 10 hr, about 11 hr, about 12 hr, about 13 hr, about 14 hr, about 15 hr, about 16 hr, about 17 hr, about 18 hr, about 19 hr, about 20 hr, about 21 hr, about 22 hr, about 23 hr, or about 24 hr. In some embodiments, the methods described herein are completed in about 0.5 hr to about 8 hr. In some embodiments, the methods of the disclosure are completed in about 2 hr to about 6 hr.

In some embodiments, the purification yield of the biologic is at least 70%, at least 80%, at least 90%, at least 95%, at least 96%, at least 97%, at least 98%, or at least 99%.

In some embodiments, the biologic is purified to at least 70%, at least 80%, at least 90%, at least 95%, at least 96%, at least 97%, at least 98%, or at least 99% purity.

In some embodiments, the purified biologic retains its biological activity and/or structure. In some embodiments, the purified biologic has enhanced biological activity.

In some embodiments, at least 400 g/m² (grams of biologic per m² of filter membrane) are purified per day. In some embodiments, at least 400 g/m², at least 500 g/m², at least 600 g/m², at least 700 g/m², at least 800 g/m², at least 900 g/m², or at least 1000 g/m² of biologic are purified per day. In some embodiments, the biologic is a protein. In some embodiments, the protein is an antibody. In some embodiments, the biologic is a virus, such as an AAV, adenovirus, or lentivirus.

In some embodiments, at least about 150 g/L (grams of biologic per liters of protein-based purification matrix) are purified per day. In some embodiments, at least about 150 g/L, at least about 200 g/L, at least about 250 g/L, at least about 300 g/L, at least about 350 g/L, at least about 400 g/L, at least about 450 g/L, at least about 500 g/L, at least about 550 g/L, at least about 600 g/L, at least about 650 g/L, at least about 700 g/L, at least about 750 g/L, at least about 800 g/L, at least about 850 g/L, at least about 900 g/L, at least about 950 g/L, or at least about 1000 g/L are purified per day. In some embodiments, the biologic is a protein. In some embodiments, the protein is an antibody. In some embodiments, the biologic is a viral particle, such as an AAV particle.

Methods for Stabilizing Biologics

The instant inventors have discovered that the purification matrices described herein may unexpectedly help stabilize biologics during production, purification, and/or storage thereof. As used herein with relation to a biologic, the terms "stabilize" or "stabilizing" refers to the ability of a purification matrix to reduce degradation or aggregation of a biologic sample comprising a plurality of biologic molecules, to prevent biologic molecules from binding other proteins, or to enhance synthesis of a biologic by a producer cell.

Thus, in some embodiments, a biologic is contacted with a purification matrix during production, purification, or storage thereof. In some embodiments, a method of increasing yield of a biologic during production thereof comprises culturing biologic-producing cells in the presence of a purification matrix. In some embodiments, a method of stabilizing biologic during production thereof comprises culturing biologic-producing cells in the presence of a purification matrix. In some embodiments, a method of stabilizing biologics during purification thereof comprises contacting the biologic with a purification matrix during purification thereof. In some embodiments, a method of stabilizing a biologic during storage thereof comprises storing the biologic in the presence of a purification matrix. In some embodiments, a method of increasing the shelf-life of a biologic comprises storing the biologic in the presence of a purification matrix.

For example, a purification matrix may be contacted with a biologic during production of the biologic in culture. Biologics such as viral particles and proteins (e.g., monoclonal antibodies), for example, may be produced in production cell lines, such as HEK293 cells. In some embodiments, the production cell lines are transfected with one or more plasmids containing various genes required to produce a biologic. Adding the purification matrix to the biologic-producing cells in culture (e.g., by adding it to the tissue culture media) may increase the yield and/or quality of the biologic obtained during this process. In some embodiments, the purification matrix may be added to the culture at a concentration of about 1 µM to about 1 mM, for example, about 1 µM, about 2 µM, about 3 µM, about 4 µM, about 5 µM, about 6 µM, about 7 µM, about 8 µM, about 9 µM, about 10 µM, about 20 µM, about 30 µM, about 40 µM, about 50 µM, about 60 µM, about 70 µM, about 80 µM, about 90 µM, about 100 µM, about 150 µM, about 200 µM, about 250 µM, about 300 µM, about 350 µM, about 400 µM, about 450 µM, about 500 µM, about 550 µM, about 600 µM, about 650 µM, about 700 µM, about 750 µM, about 800 µM, about 850 µM, about 900 µM, about 950 µM, or about 1 mM, including all values and ranges in between. In some embodiments, the purification matrix is added to culture at a concentration of about 10 µM. In some embodiments, the purification matrix is added to culture at a concentration of about 100 μM. Without being bound by any theory, it is believed that the purification matrix can bind to and/or physically surround the biologic molecules as they are produced, thereby preventing them from binding other proteins. Thus, a protein or viral particle produced by a cultured cell and secreted into culture medium, in the presence of purification matrix, would not be able to re-bind to a receptor on a producer cell. In some embodiments, adding a purification matrix to biologic-producer cell lines in culture may increase the yield of the biologic. For example, adding a purification matrix to a viral-producing cell line in culture, such as a cell line producing lentiviral particles or adenoviral particles, may result in an increase in viral titer obtained by at least 2-fold, at least 3-fold, at least 4-fold, at least 5-fold, at least 6-fold, at least 7-fold, at least 8-fold, at least 9-fold, at least 10-fold, at least 50-fold, at least 100-fold, or more, compared to cells cultured without the purification matrix. Adding a purification matrix to a protein-producing cell line in culture may result in an increase in yield of protein obtained by at least 2-fold, at least 3-fold, at least 4-fold, at least 5-fold, at least 6-fold, at least 7-fold, at least 8-fold, at least 9-fold, at least 10-fold, at least 50-fold, at least 100-fold, or more, compared to cells cultured without the purification matrix.

As another example, after a purified biologic composition is prepared (using the methods described herein, or other methods known in the art), a purification matrix may be added to the sample before storage (e.g., freezing). Without being bound by any theory, it is believed that the purification matrix can bind to and/or physically surround biologic molecules, thus preventing them from aggregating with other biologic molecules, and also helping to protect them from degradation, particularly during multiple freeze-thaw cycles. Aggregation of biologic molecules may be observed visually by microscopy and/or by a technique selected from the group consisting of x-ray scattering, laser diffraction, analytical ultracentrifugation, dynamic light scattering, nanoparticle tracking analysis, resonant mass measurement, size exclusion chromatography, gel permeation chromatography, light obscuration, and combinations thereof. In some embodiments, the biologic may be frozen and stored in the presence of a purification matrix at temperatures between about −80° C. and about 40° C., for example, about −80° C., about −75° C., about −70° C., about −65° C., about −60° C., about −55° C., about −50° C., about −45° C., about −40° C., about −35° C., about −30° C., about −25° C., about −20° C., about −15° C., about −10° C., about −5° C., about 0° C., about 4° C., about 5° C., about 10° C., about 15° C., about 20° C., about 25° C., about 30° C., about 35° C., or about 40° C.

In some embodiments, when a biologic is stored in the presence of a purification matrix, the shelf life of the biologic is at least about 10% longer as compared to a sample stored in the absence of purification matrix. For example, in some embodiments, the shelf life is at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of a biologic stored in the absence of a purification matrix at about the same temperature.

In some embodiments, a biologic is stored at about −80° C. in the presence of a purification matrix. In some embodiments, a biologic is stored at about −20° C. in the presence of a purification matrix. In some embodiments, a biologic is stored at about 4° C. in the presence of a purification matrix. In some embodiments, a biologic is stored at about 37° C. in the presence of a purification matrix. In some embodiments, when a biologic is stored in the presence of a purification matrix at about −80° C., about −20° C., about 4° C., or about 37° C., the shelf life of the biologic is at least about 10% longer than if it was stored in the absence of the purification matrix. For example, the shelf life of the biologic may be at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 450%, or at least about 500% longer than the shelf life of the biologic stored in the absence of a purification matrix at the same temperature. As used herein, increased shelf life may refer to an increase in the amount of time a biologic is stored and still retains its function. For example, a viral particle that retains its function shares substantially the same level of infectivity.

Protein-Based Purification Matrices

Capture Domains

The protein-based purification matrices described herein may comprise a capture domain. In some embodiments, the capture domain binds a biologic. Non-limiting examples of biologics include a cell, a lipid, a lipopolysaccharide, a protein, a nucleic acid, a carbohydrate, or a virus.

In some embodiments, the capture domain binds a cell. In some embodiments, the cell is selected from the group consisting of a bacterial cell, yeast cell, or an animal cell such as a mammalian cell. In some embodiments, the cell is a chicken cell, a mouse cell, a guinea pig cell, a rat cell, a rabbit cell, a goat cell, a horse cell, a sheep cell, a dog cell, a cat cell, or a cow cell. In some embodiments, the cell is a human cell.

In some embodiments, the cell is a stem cell, a bone cell, a blood cell, a muscle cell, a fat cell, a skin cell, a nerve cell, an endothelial cell, a sex cell, a pancreatic cell, or a cancer cell.

In some embodiments, the cell is an immune cell. In some embodiments, the immune cell is a T cell, a B cell, a NK cell, a peripheral blood mononuclear cell, monocyte, macrophage, or a neutrophil. In some embodiments, the cell is a T cell expressing a chimeric antigen receptor (CAR).

In some embodiments, the capture domain binds a protein. In some embodiments, the protein is fibrous, globular, or a membrane protein. In some embodiments, the protein is an antibody.

In some embodiments, the capture domain binds an antibody or antigen-binding portion of a monoclonal antibody. In some embodiments, the capture domain binds to a fragment crystalline (Fc) region. In some embodiments, the Fc region is part of an antibody or antigen-binding portion of a monoclonal antibody. In some embodiments, the capture is Protein A or Protein G, which are known to bind to a Fc region.

In some embodiments, the capture domain comprises protein A, or a derivative or fragment thereof. Protein A (see, e.g., Uniprot Accession No. Q70AB8), binds to the Fc region of most immunoglobulins. The amino acid sequence of Protein A is:

```
                                      (SEQ ID NO: 126)
(M) AAQHDEAQQNAFYQVLNMPNLNADQRNGFIQS

LKDDPSQSANVLGEAKKLNESQAPKADNNFNKEQQ

NAFYEILNMPNLNEEQRNGFIQSLKDDPSQSANLL

SEAKKLNESQAPKADNKFNKEQQNAFYEILHLPNL

NEEQRNGFIQSLKDDPSQSANLLAEAKKLNDAQAP

KADNKFNKEQQNAFYEILHLPNLTEEQRNGFIQSL

KDDPSVSKEILAEAKKLNDAQAPKEEDNNKPGKED

GNKPGKEDGN.
```

In some embodiments, the capture domain comprises Protein A having an amino acid sequence of SEQ ID NO: 126 with a mutation of A117G. In some embodiments, the capture domain comprises the B domain of Protein A or a fragment or derivative thereof, having the amino acid sequence of SEQ ID NO: 127. In some embodiments, the capture domain comprises the B domain of Protein A or a fragment or derivative thereof, having the amino acid sequence of SEQ ID NO: 127 with an amino acid mutation of A2G. In some embodiments, the capture domain comprises the C domain of Protein A or a fragment or derivative thereof, having the amino acid sequence of SEQ ID NO: 128. In some embodiments, the capture domain comprises the Z domain of Protein A or a fragment or derivative thereof, having the amino acid sequence of SEQ ID NO: 179. In some embodiments, the capture domain comprises the amino acid sequence of SEQ ID NO: 171 or an amino acid sequence having at least 90%, at least 95%, at least 96%, at least 97%, at least 98%, or at least 99% identity to SEQ ID NO: 171.

In some embodiments, the capture domain comprising Protein A, or a fragment or derivative thereof, comprises the amino acid sequence of SEQ ID NOs: 126-128 and 171 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein A, or fragment or derivative thereof, comprises a sequence with at least 90%, at least 95%, at least 97%, or at least 99% identity to any one of SEQ ID NOs: 126-128 and 171.

Unless otherwise indicated, sequence identity is determined using the National Center for Biotechnology Information (NCBI)'s Basic Local Alignment Search Tool (BLAST®), available at blast.ncbi.nlm.nih.gov/Blast.cgi. In some embodiments, the sequence identity is calculated over the entire length of the compared sequences. In some embodiments, the sequence identity is calculated over a 20-amino acid, 50-amino acid, 75-amino acid, 100-amino acid, 250-amino acid, 500-amino acid, 750-amino acid, or 1000-amino acid fragment of each compared sequence.

In some embodiments, the capture domain comprises protein G, or a derivative or fragment thereof. Protein G (see, e.g., Uniprot Accession No. P19909), binds to the Fc region of most immunoglobulins. The amino acid sequence of Protein G is:

```
                                      (SEQ ID NO: 131)
(M) EKEKKVKYFLRKSAFGLASVSAAFLVGSTVF

AVDSPIEDTPIIRNGGELTNLLGNSETTLALRNE

ESATADLTAAAVADTVAAAAAENAGAAAWEAAAA

ADALAKAKADALKEFNKYGVSDYYKNLINNAKTV

EGVKDLQAQVVESAKKARISEATDGLSDFLKSQT

PAEDTVKSIELAEAKVLANRELDKYGVSDYHKNL

INNAKTVEGVKDLQAQVVESAKKARISEATDGLS

DFLKSQTPAEDTVKSIELAEAKVLANRELDKYGV

SDYYKNLINNAKTVEGVKALIDEILAALPKTDTY

KLILNGKTLKGETTTEAVDAATAEKVFKQYANDN

GVDGEWTYDDATKTFTVTEKPEVIDASELTPAVT

TYKLVINGKTLKGETTTEAVDAATAEKVFKQYAN

DNGVDGEWTYDDATKTFTVTEKPEVIDASELTPA

VTTYKLVINGKTLKGETTTKAVDAETAEKAFKQY

ANDNGVDGVWTYDDATKTFTVTEMVTEVPGDAPT

EPEKPEASIPLVPLTPATPIAKDDAKKDDTKKED

AKKPEAKKEDAKKAETLPTTGEGSNPFFTAAALA

VMAGAGALAVASKRKED.
```

In some embodiments, the capture domain comprises the G domain of Protein G or a fragment or derivative thereof, having the amino acid sequence of SEQ ID NO: 132. In some embodiments, the capture domain comprises a fragment of Protein G, having the amino acid sequence of SEQ ID NO: 133.

In some embodiments, the capture domain comprising Protein G, or a fragment or derivative thereof, comprises the amino acid sequence of SEQ ID NOs: 131-133 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein G, or fragment or derivative thereof, comprises a sequence with at least 90%, at least 95%, at least 97%, or at least 99% identity to any one of SEQ ID NOs: 131-133.

In some embodiments, the capture domain binds to a kappa light chain. In some embodiments, the kappa light chain is part of an antibody or antigen-binding portion of a monoclonal antibody thereof. In some embodiments, the capture domain comprises protein L. Protein L binds to antibodies or antibody binding fragments thereof through interactions with the kappa light chain. The amino acid sequence of Protein L is:

```
                                      (SEQ ID NO: 129)
(M) KINKKLLMAALAGAIVVGGGANAYAAEEDN

TDNNLSMDEISDAYFDYHGDVSDSVDPVEEEID

EALAKALAEAKETAKKHIDSLNHLSETAKKLAK

NDIDSATTINAINDIVARADVMERKTAEKEEAE

KLAAAKETAKKHIDELKHLADKTKELAKRDIDS

ATTINAINDIVARADVMERKTAEKEEAEKLAAA

KETAKKHIDELKHLADKTKELAKRDIDSATTID
```

-continued

```
AINDIVARADVMERKLSEKETPEPEEEVTIKAN

LIFADGSTQNAEFKGTFAKAVSDAYAYADALKK

DNGEYTVDVADKGLTLNIKFAGKKEKPEEPKEE

VTIKVNLIFADGKTQTAEFKGTFEEATAKAYAY

ADLLAKENGEYTADLEDGGNTINIKFAGKETPE

TPEEPKEEVTIKVNLIFADGKIQTAEFKGTFEE

ATAKAYAYANLLAKENGEYTADLEDGGNTINIK

FAGKETPETPEEPKEEVTIKVNLIFADGKTQTA

EFKGTFEEATAEAYRYADLLAKVNGEYTADLED

GGYTINIKFAGKEQPGENPGITIDEWLLKNAKE

EAIKELKEAGITSDLYFSLINKAKTVEGVEALK

NEILKAHAGEETPELKDGYATYEEAEAAAKEAL

KNDDVNNAYEIVQGADGRYYYVLKIEVADEEEP

GEDTPEVQEGYATYEEAEAAAKEALKEDKVNNA

YEVVQGADGRYYYVLKIEDKEDEQPGEEPGENP

GITIDEWLLKNAKEDAIKELKEAGISSDIYFDA

INKAKTVEGVEALKNEILKAHAEKPGENPGITI

DEWLLKNAKEAAIKELKEAGITAEYLFNLINKA

KTVEGVESLKNEILKAHAEKPGENPGITIDEWL

LKNAKEDAIKELKEAGITSDIYFDAINKAKTIE

GVEALKNEILKAHKKDEEPGKKPGEDKKPEDKK

PGEDKKPEDKKPGEDKKPEDKKPGKTDKDSPNK

KKKAKLPKAGSEAEILTLAAAALSTAAGAYVSL

KKRK.
```

In some embodiments, the capture domain comprises a fragment of Protein L having an amino acid sequence of SEQ ID NO: 130.

In some embodiments, the capture domain comprising Protein L, or a fragment or derivative thereof, comprises the amino acid sequence of SEQ ID NOs: 129-130 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Protein L, or fragment or derivative thereof, comprises a sequence with at least 90%, at least 95%, at least 97%, or at least 99% identity to any one of SEQ ID NOs: 129-130.

In some embodiments, the capture domain binds an albumin, or derivative or fusion thereof. In some embodiments, the albumin is human serum albumin (HSA), bovine serum albumin (BSA), or ovalbumin. In some embodiments, the capture domain that binds an albumin comprises albumin-binding polypeptide, or a fragment or derivative thereof. In some embodiments, the albumin-binding polypeptide comprises an amino acid sequence of SEQ ID NO: 125. In some embodiments, the capture domain comprising an albumin-binding polypeptide, or fragment or derivative thereof, comprises the amino acid sequence of SEQ ID NO: 125 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising an albumin binding polypeptide, or fragment or derivative thereof, comprises a sequence with at least 90%, at least 95%, at least 97%, or at least 99% identity to SEQ ID NO: 125. In some embodiments, the capture domain that binds to albumin has an amino acid sequence of SEQ ID NO: 170, or an amino acid sequence with at least 90%, at least 95%, at least 96%, at least 97%, at least 98%, or at least 99% identity to SEQ ID NO: 170.

In some embodiments, the capture domain binds a nucleic acid. In some embodiments, the nucleic acid is a DNA or an RNA. In some embodiments, the nucleic acid is a DNA/RNA hybrid.

In some embodiments, the capture domain is a protein that binds to a nucleic acid. In some embodiments, the protein that binds to a nucleic acid binds to an adenosine and uridine rich element (ARE) of mRNA, a mRNA cap, a poly(A) tail, RNA, or double stranded DNA.

In some embodiments, the capture domain comprises mRNA decay activator protein ZFP36L2 (Tis11d), or a fragment or derivative thereof. Tis11d G (see, e.g., Uniprot Accession No. P47974) binds to an ARE. The amino acid sequence of Tis11d is: (M)STTLLSAFYDVDFLCK-TEKSLANLNLNNMLDKKAVGTPVAAAPSSGEAPGF-LRRHSASNLHALAHPAPSPGSCSPKFPGAANGSSCG-SAAAGGPTSYGTLKEPSGGGGTALLNKENKFRDR-SFSENGDRSQHLLHLQQQQKGGGGSQINSTRYKTEL-CRPFEESGTCKYGEKCQ FAHGFHELRSLTRHPKYK-TELCRTFHTIGFCPYGPRCHFIHNADERRPAPSGGA-SGDLRAFGTRDALHLGFPREPRPKLHHSLSFSGFP-SGHHQPPGGLESPLLLDSPTSRTPPPPSCSSASSCSS-SASSCSSASAASTPSGAPTCCASAAAAAAAALLY-GTGGAEDLLAPGAPCAACSSAS CANNAFAFGPELSS-LITPLAIQTHNFAAVAAAAYYRSQQQQQQQGLAPPA-QPPAPPSATL PAGAAAPPSPPFSFQLPRRLSDSPVFD-APPSPPDSLSDRDSYLSGSLSSGSLSGSESPSLDPG RRLPIFSRLSISDD (SEQ ID NO: 134). The methionine enclosed by parenthesis in the aforementioned sequence (M) or in any other sequences described herein is an initiator methionine. The presence of an initiator methionine is optional.

In some embodiments, the capture domain comprises a Tis11d fragment having an amino acid sequence of SEQ ID NO: 135. In some embodiments, the capture domain comprises the RNA binding domain of Tis11d having an amino acid sequence of SEQ ID NO: 136.

In some embodiments, the capture domain comprises Tis11d having an amino acid sequence of SEQ ID NO: 134 with at least one mutation selected from E195D, E195H, E195G, E195A, E195R, and E195K. In some embodiments, the capture domain comprises a Tis11d fragment having an amino acid sequence of SEQ ID NO: 135 with a mutation selected from at least one of E46D, E46H, E46G, E46A, E46R, and E46K. In some embodiments, the capture domain comprises the RNA binding domain of Tis11d having an amino acid sequence of SEQ ID NO: 136 with at least one mutation selected from E27D, E27H, E27G, E27A, E27R, and E27K.

In some embodiments, a capture domain comprising Tis11d, or a fragment or derivative thereof, comprises the amino acid sequence of SEQ ID NOs: 134-136 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Tis11d, or a fragment or derivative thereof, comprises a sequence with at least 90%, at least 95%, at least 97%, or at least 99% identity to any one of SEQ ID NOs: 134-136.

In some embodiments, the capture domain comprises eukaryotic translation initiation factor 4E (eIF4E), or a fragment or derivative thereof. eIF4E (see, e.g., Uniprot Accession No. P06730) binds to the mRNA cap. The amino acid sequence of eIF4E is:

```
                                       (SEQ ID NO: 137)
(M)ATVEPETTPTPNPPTTEEEKTESNQEVANPEH

YIKHPLQNRWALWFFKNDKSKTWQANLRLISKFDT

VEDFWALYNHIQLSSNLMPGCDYSLFKDGIEPMWE

DEKNKRGGRWLITLNKQQRRSDLDRFWLETLLCLI

GESFDDYSDDVCGAVVNVRAKGDKIAIWTTECENR

EAVTHIGRVYKERLGLPPKIVIGYQSHADTATKSG

STTKNRFVV.
```

In some embodiments, the capture domain comprises an eIF4E fragment having an amino acid sequence of SEQ ID NO: 138.

In some embodiments, a capture domain comprising eIF4E, or a fragment or derivative thereof, comprises the amino acid sequence of SEQ ID NOs: 137-138 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising eIF4E, or fragment or derivative thereof, comprises a sequence with at least 90%, at least 95%, at least 97%, or at least 99% identity to any one of SEQ ID NOs: 137-138.

In some embodiments, the capture domain comprises poly(A)-binding protein (PABP), or a fragment or derivative thereof. PABP (see, e.g., Uniprot Accession No. P11940) binds to the poly(A) tail of mRNA. The amino acid sequence of PABP is:

```
                                       (SEQ ID NO: 139)
(M)NPSAPSYPMASLYVGDLHPDVTEAMLYEKFSP

AGPILSIRVCRDMITRRSLGYAYVNFQQPADAERA

LDTMNFDVIKGKPVRIMWSQRDPSLRKSGVGNIFI

KNLDKSIDNKALYDTFSAFGNILSCKVVCDENGSK

GYGFVHFETQEAAERAIEKMNGMLLNDRKVFVGRF

KSRKEREAELGARAKEFTNVYIKNEGEDMDDERLK

DLFGKFGPALSVKVMTDESGKSKGFGFVSFERHED

AQKAVDEMNGKELNGKQIYVGRAQKKVERQTELKR

KFEQMKQDRITRYQGVNLYVKNLDDGIDDERLRKE

FSPFGTITSAKVMMEGGRSKGFGFVCFSSPEEATK

AVTEMNGRIVATKPLYVALAQRKEERQAHLTNQYM

QRMASVRAVPNPVINPYQPAPPSGYFMAAIPQTQN

RAAYYPPSQIAQLRPSPRWTAQGARPHPFQNMPGA

IRPAAPRPPFSTMRPASSQVPRVMSTQRVANTSTQ

TMGPRPAAAAAAATPAVRTVPQYKYAAGVRNPQQH

LNAQPQVTMQQPAVHVQGQEPLTASMLASAPPQEQ

KQMLGERLFPLIQAMHPTLAGKITGMLLEIDNSEL

LHMLESPESLRSKVDEAVAVLQAHQAKEAAQKAVN

SATGVPTV.
```

In some embodiments, the capture domain comprises a PABP fragment having an amino acid sequence of SEQ ID NO: 140. In some embodiments, the capture domain comprises the RNA recognition motif (RRM) 1 domain of PABP having an amino acid sequence of SEQ ID NO: 141. In some embodiments, the capture domain comprises the RRM2 domain of PABP having an amino acid sequence of SEQ ID NO: 142. In some embodiments, the capture domain comprises the RRM3 domain of PABP having an amino acid sequence of SEQ ID NO: 143. In some embodiments, the capture domain comprises the RRM4 domain of PABP having an amino acid sequence of SEQ ID NO: 144.

In some embodiments, a capture domain comprising PABP, or a fragment or derivative thereof, comprises the amino acid sequence of any one of SEQ ID NOs: 139-144 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising PABP, or fragment or derivative thereof, comprises a sequence with at least 90%, at least 95%, at least 97%, or at least 99% identity to any one of SEQ ID NOs: 139-144.

In some embodiments, the capture domain comprises Z-DNA binding protein 1 (ZBP1), or a fragment or derivative thereof. ZBP1 (see, e.g., Uniprot Accession No. Q9H171) binds to double stranded DNA. The amino acid sequence of ZBP1 is:

```
                                       (SEQ ID NO: 145)
MAQAPADPGREGHLEQRILQVLTEAGSPVKLAQLV

KECQAPKRELNQVLYRMKKELKVSLTSPATWCLGG

TDPEGEGPAELALSSPAERPQQHAATIPETPGPQF

SQQREEDIYRFLKDNGPQRALVIAQALGMRTAKDV

NRDLYRMKSRHLLDMDEQSKAWTIYRPEDSGRRAK

SASIIYQHNPINMICQNGPNSWISIANSEATQIGH

GNIITRQTVSREDGSAGPRHLPSMAPGDSSTWGTL

VDPWGPQDIHMEQSILRRVQLGHSNEMRLHGVPSE

GPAHIPPGSPPVSATAAGPEASFEARIPSPGTHPE

GEAAQRIHMKSCFLEDATIGNSNKMSISPGVAGPG

GVAGSGEGEPGEDAGRRPADTQSRSHFPRDIGQPI
```

-continued
TPSHSKLTPKLETMTLGNRSHKAAEGSHYVDEASH

EGSWWGGGI.

In some embodiments, the capture domain comprises Z-binding domain 1 of ZBP1 having an amino acid sequence of SEQ ID NO: 146. In some embodiments, the capture domain comprises Z-binding domain 2 of ZBP1 having an amino acid sequence of SEQ ID NO: 147.

In some embodiments, a capture domain comprising ZBP1, or a fragment or derivative thereof, comprises the amino acid sequence of any one of SEQ ID NOs: 145-147 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ZBP1, or fragment or derivative thereof, comprises a sequence with at least 90%, at least 95%, at least 97%, or at least 99% identity to any one of SEQ ID NOs: 145-147.

In some embodiments, the capture domain comprises PUM-HD domain-containing protein (PUM-HD), or a fragment or derivative thereof. PUM-HD (see, e.g., Uniprot Accession No. B2BXX4) binds to mRNA. The amino acid sequence of PUM-HD is:

(SEQ ID NO: 148)
(M)HRGNEDLSFGDDYEKEIGLLLGEQQRRQEEAD

EIEKELNLYRSGSAPPTVDGSVNAAGGLFNGGGRG

PFMEFGGGNKGNGFGGDDDELRKDPAYLSYYYANM

KLNPRLPPPLMSREDLRVAQRLKGSSNVLGGVGDR

RNVNESRSLFSMPPGFDQMNEFEAEKTNASSSEWD

ANGLIGLPGLGLGGKQKSFADIFQPDMGHPVSQQP

SRPASRNAFDENVDSTNNQSPSASQGIGAPPPYSY

AAVLGSSLSRNGTPDPQAVARVPSPCLTPIGSGRV

SSNDKRNTSNQSPFNGVTSGLNESSDLVNALSGMN

LSGSGGLDDRGQAEQDVEKVRNYMFGFQGGHNEVS

QHVFPNKSDQAQKATGSLRNLHMRGSQGSAYNGGG

LANPYQHLDSPNYCLNNYALNPAVASVMANQLGNS

NFSPMYDNYSAASALGFSGMDSRLHGGGFESRNLG

RSNRMMGGGGLQSHMADPMYHQYGRYSENVDALDL

LNDPAMDRSFMGNSYMNMLELQRAYLGAQKSQYGV

PYKSGSPNSHSYYGSPTFGSNMSYPGSPLAHHAMQ

NSLMSPCSPMRRGEVNMRYPSATRNYSGGVMGSWH

MDASLDEGFGSSLLEEFKSNKTRGFELSEIAGHVV

EFSADQYGSRFIQQKLETATTDEKNMVYEEIMPHA

LALMTDVFGNYVIQKFFEHGLPPQRRELGDKLFEN

VLPLSLQMYGCRVIQKAIEVVDLDQKIKMVKELDG

HVMRCVRDQNGNHVVQKCIECVPEENIEFIISTFF

GHVVSLSTHPYGCRVIQRVLEHCHDPDTQSKVMEE

ILSTVSMLAQDQYGNYVVQHVLEHGKPDERTVIIK

ELAGKIVQMSQQKFASNVVEKCLTFGGPEERELLV

NEMLGTTDENEPLQAMMKDQFANYVVQKVLETCDD

QQRELILTRIKVHLNALKKYTYGKHVVARIEKLVA

AGGMHMFLLFPLGLKEENGFAVPNPASDVVRPQVL

YSLTRVDGSAIAF.

In some embodiments, a capture domain comprising PUM-HD, or a fragment or derivative thereof, comprises the amino acid sequence of SEQ ID NO: 148 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising PUM-HD, or fragment or derivative thereof, comprises a sequence with at least 90%, at least 95%, at least 97%, or at least 99% identity to SEQ ID NO: 148.

In some embodiments, the capture domain binds a virus. In some embodiments, the virus is an adenovirus, an adeno-associated virus (AAV), a lentivirus, a retrovirus, a poxvirus or a herpesvirus. In some embodiments, the virus is a wildtype or mutant AAV selected from AAV1, AAV2, AAV3 (including types 3A and 3B), AAV4, AAV5, AAV6, AAV7, AAV8, AAV9, AAV10, AAV11, AAV12, AAV13, AAVrh32.33, AAVrh8, AAVrh10, AAVrh74, AAVhu.68, avian AAV, bovine AAV, canine AAV, equine AAV, ovine AAV, snake AAV, bearded dragon AAV, AAV2i8, AAV2g9, AAV-LK03, AAV7m8, AAV Anc80, AAV PHP.B, and any other AAV now known or later discovered. In some embodiments, the capture domain that binds to an AAV particle has an amino acid sequence of SEQ ID NO: 166, or an amino acid sequence with at least 90%, at least 95%, at least 96%, at least 97%, at least 98%, or at least 99% identity to SEQ ID NO: 166.

In some embodiments, the capture domain binds an adenovirus particle. Adenoviruses are medium-sized (90-100 nm) nonenveloped viruses from the family Adenoviridae with an icosahedral nucleocapsid containing a double stranded DNA genome. There are four genera of the family Adenoviridae (e.g., Aviadenovirus, Mastadenovirus, Atadenovirus, Ichtadenovirus, Siadenovirus). In some embodiments, the capture domain binds to an adenovirus from Aviadenovirus, Mastadenovirus, Atadenovirus, Ichtadenovirus, or Siadenovirus. In some embodiments, the capture domain binds to an adenovirus from Mastadenovirus. Human adenoviruses are grouped into seven different adenovirus serotypes: A, B, C, D, E, F, G, and H. In some embodiments, the capture domain binds to a human adenovirus particle of serotypes A, B, C, D, E, F, G, or H.

The adenovirus capsid comprises three major types of proteins: hexon, penton base, and fiber. The coxsackievirus and adenovirus receptor (see, e.g., Uniprot Accession No. P78310), which is expressed on heart, brain epithelial, and endothelial cells, binds to the fiber protein of the adenovirus capsid. The amino acid sequence of the coxsackievirus and adenovirus receptor from *Homo sapiens* is:

(SEQ ID NO: 62)
(M)ALLLCFVLLCGVVDFARSLSITTPEEMIEKAK

GETAYLPCKFTLSPEDQGPLDIEWLISPADNQKVD

QVIILYSGDKIYDDYYPDLKGRVHFTSNDLKSGDA

-continued

```
SINVTNLQLSDIGTYQCKVKKAPGVANKKIHLVVL

VKPSGARCYVDGSEEIGSDFKIKCEPKEGSLPLQY

EWQKLSDSQKMPTSWLAEMTSSVISVKNASSEYSG

TYSCTVRNRVGSDQCLLRLNVVPPSNKAGLIAGAI

IGTLLALALIGLIIFCCRKKRREEKYEKEVHHDIR

EDVPPPKSRTSTARSYIGSNHSSLGSMSPSNMEGY

SKTQYNQVPSEDFERTPQSPTLPPAKVAAPNLSRM

GAIPVMIPAQSKDGSIV.
```

In some embodiments, a capture domain of a purification matrix provided herein comprises the coxsackievirus and adenovirus receptor, or a fragment or derivative thereof.

In some embodiments, the capture domain comprising a coxsackievirus and adenovirus receptor, or fragment thereof, comprises an amino acid sequence selected from any one of SEQ ID NOs: 62-72. In some embodiments, the capture domain comprising a coxsackievirus and adenovirus receptor, or fragment thereof, comprises the amino acid sequence of any one of SEQ ID NOs: 62-72 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising a coxsackievirus and adenovirus receptor, or fragment thereof, comprises a sequence with at least 90%, at least 95%, at least 97%, or at least 99% identity to any one of SEQ ID NOs: 62-72.

In some embodiments, the capture domain comprises the extracellular domain of the coxsackievirus and adenovirus receptor, or a fragment thereof. In some embodiments, the capture domain comprising the extracellular domain of the coxsackievirus and adenovirus receptor has an amino acid sequence of SEQ ID NO: 63 or 64. In some embodiments, the capture domain comprises domain 1 of the coxsackievirus and adenovirus receptor, or a fragment thereof. In some embodiments, the capture domain comprising domain 1 of the coxsackievirus and adenovirus receptor has an amino acid sequence of SEQ ID NO: 65. In some embodiments, the capture domain comprises domain 2 of the coxsackievirus and adenovirus receptor, or a fragment thereof. In some embodiments, the capture domain comprising domain 2 of the coxsackievirus and adenovirus receptor has an amino acid sequence of SEQ ID NO: 66. In some embodiments, the capture domain comprises isoform 3 of the coxsackievirus and adenovirus receptor, or a fragment thereof. In some embodiments, the capture domain comprising isoform 3 of the coxsackievirus and adenovirus receptor has an amino acid sequence of SEQ ID NO: 67. In some embodiments, the capture domain comprises isoform 4 of the coxsackievirus and adenovirus receptor, or a fragment thereof. In some embodiments, the capture domain comprising isoform 4 of the coxsackievirus and adenovirus receptor has an amino acid sequence of SEQ ID NO: 68. In some embodiments, the capture domain comprises isoform 5 of the coxsackievirus and adenovirus receptor, or a fragment thereof. In some embodiments, the capture domain comprising isoform 5 of the coxsackievirus and adenovirus receptor has an amino acid sequence of SEQ ID NO: 69. In some embodiments, the capture domain comprises isoform 7 of the coxsackievirus and adenovirus receptor, or a fragment thereof. In some embodiments, the capture domain comprising isoform 7 of the coxsackievirus and adenovirus receptor has an amino acid sequence of SEQ ID NO: 70.

In some embodiments, the capture domain comprises an amino acid sequence of M(RAIVFRVQWLRRYFVNG-SRSGGG)$_n$, where n is an integer from 1 to 8 (SEQ ID NO: 71), for example, n is 1, 2, 3, 4, 5, 6, 7, or 8. In some embodiments, the capture domain comprises an amino acid sequence of (RAIVFRVQWLRRYFVNGSRSGGG)$_n$, wherein n is an integer from 1 to 8 (SEQ ID NO: 72), for example, 1, 2, 3, 4, 5, 6, 7, or 8.

In some embodiments, the capture domain that binds to an adenovirus particle has an amino acid sequence of SEQ ID NO: 167, or an amino acid sequence with at least 90%, at least 95%, at least 96%, at least 97%, at least 98%, or at least 99% identity to SEQ ID NO: 167.

In some embodiments, a capture domain of a purification matrix provided herein comprises the cluster of differentiation 80 (CD80), or a fragment or derivative thereof. CD80 (see, e.g., Uniprot Accession No. P33681) is a type 1 membrane protein of the immunoglobulin superfamily. CD80 binds to at least the knob domain of the fiber protein of adenovirus species B. The amino acid sequence of CD80 from *Homo sapiens* is

```
                                    (SEQ ID NO: 98)
(M)GHTRRQGTSPSKCPYLNFFQLLVLAGLSHFCS

GVIHVTKEVKEVATLSCGHNVSVEELAQTRIYWQK

EKKMVLTMMSGDMNIWPEYKNRTIFDITNNLSIVI

LALRPSDEGTYECVVLKYEKDAFKREHLAEVTLSV

KADFPTPSISDFEIPTSNIRRIICSTSGGFPEPHL

SWLENGEELNAINTTVSQDPETELYAVSSKLDFNM

TTNHSFMCLIKYGHLRVNQTFNWNTTKQEHFPDNL

LPSWAITLISVNGIFVICCLTYCFAPRCRERRRNE

RLRRESVRPV.
```

In some embodiments, the capture domain comprises the extracellular domain of CD80, or a fragment or derivative thereof, having an amino acid sequence of SEQ ID NO: 99 or SEQ ID NO: 100.

In some embodiments, the capture domain comprising CD80, or a fragment or derivative thereof, comprises an amino acid sequence selected from any one of SEQ ID NOs: 98-100. In some embodiments, the capture domain comprising CD80, or a fragment or derivative thereof, comprises the amino acid sequence of any one of SEQ ID NOs: 98-100 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD80, or fragment thereof, comprises a sequence with at least 90%, at least 95%, at least 97%, or at least 99% identity to any one of SEQ ID Nos: 98-100.

In some embodiments, a capture domain of a purification matrix provided herein comprises the cluster of differentiation 86 (CD86), or a fragment or derivative thereof. CD86 (see, e.g., Uniprot Accession No. P42081) is a type 1 membrane protein of the immunoglobulin superfamily.

CD86 binds to at least the knob domain of the fiber protein of adenovirus species B. The amino acid sequence of CD86 from *Homo sapiens* is (SEQ ID NO: 101)
(M)DPQCTMGLSNILFVMAFLLSGAAPLKIQAYFN

ETADLPCQFANSQNQSLSELVVFWQDQENLVLNEV

YLGKEKFDSVHSKYMGRTSFDSDSWTLRLHNLQIK

DKGLYQCIIHHKKPTGMIRIHQMNSELSVLANFSQ

PEIVPISNITENVYINLTCSSIEGYPEPKKMSVLL

RTKNSTIEYDGVMQKSQDNVTELYDVSISLSVSFP

DVTSNMTIFCILETDKTRLLSSPFSIELEDPQPPP

DHIPWITAVLPTVIICVMVFCLILWKWKKKKRPRN

SYKCGTNTMEREESEQTKKREKIHIPERSDEAQRV

FKSSKTSSCDKSDTCF.

In some embodiments, the capture domain comprises the extracellular domain of CD86. In some embodiments, the capture domain comprises the extracellular domain of CD86, having an amino acid sequence of SEQ ID NO: 102. In some embodiments, the capture domain comprises a fragment of the extracellular domain of CD86, having an amino acid sequence of SEQ ID NOs: 103 or 104.

In some embodiments, the capture domain comprising CD86, or a fragment or derivative thereof, comprises an amino acid sequence selected from any one of SEQ ID NOs: 101-104. In some embodiments, the capture domain comprising CD86, or a fragment or derivative thereof, comprises the amino acid sequence of any one of SEQ ID NOs: 101-104 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD86, or fragment thereof, comprises a sequence with at least 90%, at least 95%, at least 97%, or at least 99% identity to any one of SEQ ID Nos: 101-104.

In some embodiments, the capture domain binds a lentovirus particle. Lentivirus is a genus of retroviruses that causes chronic and deadly diseases characterized by long incubation periods. Examples of lentiviruses include human immunodeficiency virus (HIV) and vesicular stomatitis virus (VSV). There are five serogroups of lentivirus: bovine, equine, feline, ovinecaprine, and primate. In some embodiments, the capture domain binds a lentovirus particle of the bovine, equine, feline, ovinecaprine, or primate serogroups. In some embodiments, lentiviruses infect host cells via binding to the low-density lipoprotein receptor (LDLR) or cluster of differentiation 4 (CD4).

In some embodiments, the capture domain that binds to an lentivirus particle has an amino acid sequence of SEQ ID NO: 168, or an amino acid sequence with at least 90%, at least 95%, at least 96%, at least 97%, at least 98%, or at least 99% identity to SEQ ID NO: 168. In some embodiments, the capture domain that binds to an lentivirus particle has an amino acid sequence of SEQ ID NO: 169, or an amino acid sequence with at least 90%, at least 95%, at least 96%, at least 97%, at least 98%, or at least 99% identity to SEQ ID NO: 169.

In some embodiments, a capture domain of a purification matrix provided herein comprises the LDLR, or a fragment or derivative thereof. LDLR (see, e.g., Uniprot Accession No. P01130) is a cell-surface receptor that mediates the endocytosis of cholesterol rich low-density lipoprotein. The amino acid sequence of LDLR from *Homo sapiens* is (SEQ ID NO: 73)
(M)GPWGWKLRWTVALLLAAAGTAVGDRCERNEFQ

CQDGKCISYKWVCDGSAECQDGSDESQETCLSVTC

KSGDFSCGGRVNRCIPQFWRCDGQVDCDNGSDEQG

CPPKTCSQDEFRCHDGKCISRQFVCDSDRDCLDGS

DEASCPVLTCGPASFQCNSSTCIPQLWACDNDPDC

EDGSDEWPQRCRGLYVFQGDSSPCSAFEFHCLSGE

CIHSSWRCDGGPDCKDKSDEENCAVATCRPDEFQC

SDGNCIHGSRQCDREYDCKDMSDEVGCVNVTLCEG

PNKFKCHSGECITLDKVCNIVIARDCRDWSDEPIK

ECGTNECLDNNGGCSHVCNDLKIGYECLCPDGFQL

VAQRRCEDIDECQDPDTCSQLCVNLEGGYKCQCEE

GFQLDPHTKACKAVGSIAYLFFTNRHEVRKMTLDR

SEYTSLIPNLRNVVALDTEVASNRIYWSDLSQRMI

CSTQLDRAHGVSSYDTVISRDIQAPDGLAVDWIHS

NIYWTDSVLGTVSVADTKGVKRKTLFRENGSKPRA

IVVDPVHGFMYWTDWGTPAKIKKGGLNGVDIYSLV

TENIQWPNGITLDLLSGRLYWVDSKLHSISSIDVN

GGNRKTILEDEKRLAHPFSLAVFEDKVFWTDIINE

AIFSANRLTGSDVNLLAENLLSPEDMVLFHNLTQP

RGVNWCERTTLSNGGCQYLCLPAPQINPHSPKFTC

ACPDGMLLARDMRSCLTEAEAAVATQETSTVRLKV

SSTAVRTQHTTTRPVPDTSRLPGATPGLTTVEIVT

MSHQALGDVAGRGNEKKPSSVRALSIVLPIVLLVF

LCLGVFLLWKNWRLKNINSINFDNPVYQKTTEDEV

HICHNQDGYSYPSRQMVSLEDDVA.

In some embodiments, the capture domain comprises the extracellular domain of LDLR having an amino acid sequence of SEQ ID NO: 74. In some embodiments, the capture domain comprises a fragment of the extracellular domain of LDLR having an amino acid sequence of SEQ ID NO: 77. In some embodiments, the capture domain comprises the CR2 domain of LDLR having an amino acid sequence of SEQ ID NO: 75. In some embodiments, the capture domain comprises the CR3 domain of LDLR having an amino acid sequence of SEQ ID NO: 76.

In some embodiments, the capture domain comprising LDLR, or a fragment or derivative thereof, comprises an amino acid sequence selected from any one of SEQ ID NOs: 73-76. In some embodiments, the capture domain comprising LDLR, or a fragment or derivative thereof, comprises the amino acid sequence of any one of SEQ ID NOs: 73-76 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising LDLR, or fragment thereof, comprises a sequence with at least 90%, at least 95%, at least 97%, or at least 99% identity to any one of SEQ ID Nos: 73-76.

In some embodiments, a capture domain of a purification matrix provided herein comprises CD4, or a fragment or derivative thereof. In some embodiments, a capture domain comprising CD4 binds to a lentivirus particle or a retrovirus particle. In some embodiments, CD4 binds to glycoprotein 120 (gp120) of human immunodeficiency virus.

CD4 (see, e.g., Uniprot Accession No. P01730) is a glycoprotein found on the surface of immune cells such as T helper cells, monocytes, macrophages, and dendritic cells. The amino acid sequence of CD4 from *Homo sapiens* is (SEQ ID NO: 78)
(M)NRGVPFREILLLVLQLALLPAATQGKKVVLGK

KGDTVELTCTASQKKSIQFHWKNSNQIKILGNQGS

FLTKGPSKLNDRADSRRSLWDQGNFPLIIKNLKIE

DSDTYICEVEDQKEEVQLLVFGLTANSDTHLLQGQ

SLTLTLESPPGSSPSVQCRSPRGKNIQGGKTLSVS

QLELQDSGTWTCTVLQNQKKVEFKIDIVVLAFQKA

SSIVYKKEGEQVEFSFPLAFTVEKLTGSGELWWQA

ERASSSKSWITFDLKNKEVSVKRVTQDPKLQMGKK

LPLHLTLPQALPQYAGSGNLTLALEAKTGKLHQEV

NLVVMRATQLQKNLTCEVWGPTSPKLMLSLKLENK

EAKVSKREKAVWVLNPEAGMWQCLLSDSGQVLLES

NIKVLPTWSTPVQPMALIVLGGVAGLLLFIGLGIF

FCVRCRHRRRQAERMSQIKRLLSEKKTCQCPHRFQ

KTCSPI.

In some embodiments, the capture domain comprises CD4 having an amino acid sequence of SEQ ID NO: 78. In some embodiments, the capture domain comprises CD4 having an amino acid sequence of SEQ ID NO: 78 having at least one, at least two, at least three, or at least four mutations of amino acids 112, 113, 116, and 117 to glycine, alanine, lysine, arginine, or histidine.

In some embodiments, the capture domain comprises the extracellular domain of CD4. In some embodiments, the capture domain comprises the extracellular domain of CD4 having an amino acid sequence of SEQ ID NO: 79.

In some embodiments, the capture domain comprises a fragment of the extracellular domain of CD4 having an amino acid sequence of SEQ ID NO: 80. In some embodiments, the capture domain comprises domain 1 of CD4 having an amino acid sequence of SEQ ID NO: 81. In some embodiments, the capture domain comprises the extracellular domain of CD4 or a fragment or derivative thereof (SEQ ID NOs: 79-81) having at least one, at least two, at least three, or at least four mutations at amino acids 88, 89, 92, and 93 to glycine, alanine, lysine, arginine, or histidine.

In some embodiments, the capture domain comprising CD4, or a fragment or derivative thereof, comprises an amino acid sequence selected from any one of SEQ ID NOs: 78-81. In some embodiments, the capture domain compris-ing CD4, or a fragment or derivative thereof, comprises the amino acid sequence of any one of SEQ ID NOs: 78-81 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD4, or fragment thereof, comprises a sequence with at least 90%, at least 95%, at least 97%, or at least 99% identity to any one of SEQ ID Nos: 78-81.

In some embodiments, a capture domain of a purification matrix provided herein comprises cluster of differentiation 46 (CD46), or a fragment or derivative thereof. In some embodiments, a capture domain comprising CD46 or a fragment or derivative thereof binds to a measles virus particle, a herpesvirus particle, an adenovirus particle, *Streptococcus pyogenes*, or pathogenic Nesseria. CD46 (see, e.g., Uniprot Accession No. P15529) is a type 1 membrane protein and is a regulatory part of the complement system. In some embodiments, a capture domain comprising CD46 or a fragment or derivative thereof binds to group B adenoviruses. In some embodiments, a capture domain comprising CD46 or a fragment or derivative thereof binds to human herpesvirus-6. The amino acid sequence of CD46 is:

(SEQ ID NO: 82)
(M)EPPGRRECPFPSWRFPGLLLAAMVLLLYSFSD

ACEEPPTFEAMELIGKPKPYYEIGERVDYKCKKGY

FYIPPLATHTICDRNHTWLPVSDDACYRETCPYIR

DPLNGQAVPANGTYEFGYQMHFICNEGYYLIGEEI

LYCELKGSVAIWSGKPPICEKVLCTPPPKIKNGKH

TFSEVEVFEYLDAVTYSCDPAPGPDPFSLIGESTI

YCGDNSVWSRAAPECKVVKCRFPVVENGKQISGFG

KKFYYKATVMFECDKGFYLDGSDTIVCDSNSTWDP

PVPKCLKVLPPSSTKPPALSHSVSTSSTTKSPASS

ASGPRPTYKPPVSNYPGYPKPEEGILDSLDVWVIA

VIVIAIVVGVAVICVVPYRYLQRRKKKGTYLTDET

HREVKFTSL.

In some embodiments, a capture domain comprises the extracellular domain of CD46 or a fragment or derivative thereof. In some embodiments, a capture domain comprises the extracellular domain of CD46 or a fragment or derivative thereof, having an amino acid sequence of SEQ ID NO: 83 or SEQ ID NO: 84. In some embodiments, the capture domain comprises domain 1 of CD46 having an amino acid sequence of SEQ ID NO: 85. In some embodiments, the capture domain comprises domain 2 of CD46 having an amino acid sequence of SEQ ID NO: 86. In some embodiments, the capture domain comprises domain 3 of CD46 having an amino acid sequence of SEQ ID NO: 87. In some embodiments, the capture domain comprises domain 4 of CD46 having an amino acid sequence of SEQ ID NO: 88. In some embodiments, the capture domain comprises domain 5 of CD46 having an amino acid sequence of SEQ ID NO: 89.

In some embodiments, the capture domain comprising CD46, or a fragment or derivative thereof, comprises an amino acid sequence selected from any one of SEQ ID NOs: 82-89. In some embodiments, the capture domain comprising CD46, or a fragment or derivative thereof, comprises the amino acid sequence of any one of SEQ ID NOs: 82-89 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising CD46, or fragment thereof, comprises a sequence with at least 90%, at least 95%, at least 97%, or at least 99% identity to any one of SEQ ID Nos: 82-89.

In some embodiments, the capture domain binds a measles virus particle. Measles virus is a single-stranded, negative-sense, enveloped, non-segmented RNA virus of the genus Morbillivirus within the family Paramyxoviridae. The measles virus has two envelope glycoproteins on the viral surface: hemagglutinin (H) and membrane fusion protein (F). Receptors for the measles H protein include CD46, the signaling lymphocyte activation molecule (SLAMF1), and the cell adhesion molecule Nectin-4.

In some embodiments, a capture domain of a purification matrix provided herein comprises SLAMF1, or a fragment or derivative thereof. In some embodiments, a capture domain comprising SLAMF1 or a fragment or derivative thereof binds to a measles virus particle. SLAMF1 (see, e.g., Uniprot Accession No. Q13291) belongs to the signaling lymphocytic activation molecule family. The amino acid sequence of SLAMF1 is:

```
                                      (SEQ ID NO: 90)
(M) DPKGLLSLTFVLFLSLAFGASYGTGGRMMNCP

KILRQLGSKVLLPLTYERINKSMNKSIHIVVTMAK

SLENSVENKIVSLDPSEAGPPRYLGDRYKFYLENL

TLGIRESRKEDEGWYLMTLEKNVSVQRFCLQLRLY

EQVSTPEIKVLNKTQENGTCTLILGCTVEKGDHVA

YSWSEKAGTHPLNPANSSHLLSLTLGPQHADNIYI

CTVSNPISNNSQTFSPWPGCRTDPSETKPWAVYAG

LLGGVEVIILEVIVVILQLRRRGKTNHYQTTVEKK

SLTIYAQVQKPGPLQKKLDSFPAQDPCTTIYVAAT

EPVPESVQETNSITVYASVTLPES.
```

In some embodiments, a capture domain comprises the extracellular domain of SLAMF1 or a fragment or derivative thereof. In some embodiments, a capture domain comprises the extracellular domain of SLAMF1 or a fragment or derivative thereof, having an amino acid sequence of SEQ ID NO: 91 or SEQ ID NO: 92.

In some embodiments, the capture domain comprising SLAMF1, or a fragment or derivative thereof, comprises an amino acid sequence selected from any one of SEQ ID NOs: 90-92. In some embodiments, the capture domain comprising SLAMF1, or a fragment or derivative thereof, comprises the amino acid sequence of any one of SEQ ID NOs: 90-92 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLAMF1, or fragment thereof, comprises a sequence with at least 90%, at least 95%, at least 97%, or at least 99% identity to any one of SEQ ID Nos: 90-92.

In some embodiments, a capture domain of a purification matrix provided herein comprises Nectin-4, or a fragment or derivative thereof. In some embodiments, a capture domain comprising Nectin-4 or a fragment or derivative thereof binds to a measles virus particle. Nectin-4 (see, e.g., Uniprot Accession No. Q96NY8) belongs to the family of cellular adhesion molecules involved in calcium-independent cellular adhesion. The amino acid sequence of Nectin-4 is:

```
                                      (SEQ ID NO: 93)
(M) PLSLGAEMWGPEAWLLLLLLLASFTGRCPAGE

LETSDVVTVVLGQDAKLPCFYRGDSGEQVGQVAWA

RVDAGEGAQELALLHSKYGLHVSPAYEGRVEQPPP

PRNPLDGSVLLRNAVQADEGEYECRVSTFPAGSFQ

ARLRLRVLVPPLPSLNPGPALEEGQGLTLAASCTA

EGSPAPSVTWDTEVKGTTSSRSFKHSRSAAVTSEF

HLVPSRSMNGQPLTCVVSHPGLLQDQRITHILHVS

FLAEASVRGLEDQNLWHIGREGAMLKCLSEGQPPP

SYNWTRLDGPLPSGVRVDGDTLGFPPLTTEHSGIY

VCHVSNEFSSRDSQVTVDVLDPQEDSGKQVDLVSA

SVVVVGVIAALLFCLLVVVVVLMSRYHRRKAQQMT

QKYEEELTLTRENSIRRLHSHHTDPRSQPEESVGL

RAEGHPDSLKDNSSCSVMSEEPEGRSYSTLTTVRE

IETQTELLSPGSGRAEEEEDQDEGIKQAMNHFVQE

NGTLRAKPTGNGIYINGRGHLV.
```

In some embodiments, a capture domain comprises the extracellular domain of Nectin-4 or a fragment or derivative thereof. In some embodiments, a capture domain comprises the extracellular domain of Nectin-4 or a fragment or derivative thereof, having an amino acid sequence of SEQ ID NO: 94. In some embodiments, a capture domain comprises domain 1 of Nectin-4 or a fragment or derivative thereof, having an amino acid sequence of SEQ ID NO: 95. In some embodiments, a capture domain comprises domain 2 of Nectin-4 or a fragment or derivative thereof, having an amino acid sequence of SEQ ID NO: 96. In some embodiments, a capture domain comprises domain 3 of Nectin-4 or a fragment or derivative thereof, having an amino acid sequence of SEQ ID NO: 97.

In some embodiments, the capture domain comprising Nectin-4, or a fragment or derivative thereof, comprises an amino acid sequence selected from any one of SEQ ID NOs: 93-97. In some embodiments, the capture domain comprising Nectin-4, or a fragment or derivative thereof, comprises the amino acid sequence of any one of SEQ ID NOs: 93-97 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising Nectin-4, or fragment thereof, comprises a sequence with at least 90%, at least 95%, at least 97%, or at least 99% identity to any one of SEQ ID Nos: 93-97.

In some embodiments, the capture domain binds a baboon endogenous virus particle. Baboon endogenous virus (BaEV) is a type C endogenous oncovirus. BaEV contains a type D envelope (env) gene. BaEV virus particles bind to neutral amino acid transporter B(0) (SLC1A5) and/or neutral amino acid transporter A (SLC1A4).

In some embodiments, a capture domain of a purification matrix provided herein comprises SLC1A5, or a fragment or derivative thereof. SLC1A5 (see, e.g., Uniprot Accession No. Q15758) is a sodium-dependent amino acid transporter. The amino acid sequence of SLC1A5 is:

```
                                        (SEQ ID NO: 105)
(M)VADPPRDSKGLAAAEPTANGGLALASIEDQGA

AAGGYCGSRDQVRRCLRANLLVLLTVVAVVAGVAL

GLGVSGAGGALALGPERLSAFVFPGELLLRLLRMI

ILPLVVCSLIGGAASLDPGALGRLGAWALLFFLVT

TLLASALGVGLALALQPGAASAAINASVGAAGSAE

NAPSKEVLDSFLDLARNIFPSNLVSAAFRSYSTTY

EERNITGTRVKVPVGQEVEGMNILGLVVFAIVFGV

ALRKLGPEGELLIRFFNSFNEATMVLVSWIMWYAP

VGIMFLVAGKIVEMEDVGLLFARLGKYILCCLLGH

AIHGLLVLPLIYFLFTRKNPYRFLWGIVTPLATAF

GTSSSSATLPLMMKCVEENNGVAKHISRFILPIGA

TVNMDGAALFQCVAAVFIAQLSQQSLDFVKITTIL

VTATASSVGAAGIPAGGVLTLAIILEAVNLPVDHI

SLILAVDWLVDRSCTVLNVEGDALGAGLLQNYVDR

TESRSTEPELIQVKSELPLDPLPVPTEEGNPLLKH

YRGPAGDATVASEKESVM.
```

In some embodiments, a capture domain comprises the extracellular domain of SLC1A5 or a fragment or derivative thereof. In some embodiments, a capture domain comprises the extracellular domain of SLC1A5 or a fragment or derivative thereof, having an amino acid sequence of any one of SEQ ID NOs: 106-110.

In some embodiments, the capture domain comprising SLC1A5, or a fragment or derivative thereof, comprises an amino acid sequence selected from any one of SEQ ID NOs: 105-110. In some embodiments, the capture domain comprising SLC1A5, or a fragment or derivative thereof, comprises the amino acid sequence of any one of SEQ ID NOs: 105-110 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC1A5, or fragment thereof, comprises a sequence with at least 90%, at least 95%, at least 97%, or at least 99% identity to any one of SEQ ID NOs: 105-110.

In some embodiments, a capture domain of a purification matrix provided herein comprises SLC1A4, or a fragment or derivative thereof. SLC1A4 (see, e.g., Uniprot Accession No. P43007) is a transporter of alanine, serine, cysteine, and threonine. The amino acid sequence of SLC1A4 is:

```
                                        (SEQ ID NO: 111)
(M)EKSNETNGYLDSAQAGPAAGPGAPGTAAGRAR

RCAGFLRRQALVLLTVSGVLAGAGLGAALRGLSLS

RTQVTYLAFPGEMLLRMLRMIILPLVVCSLVSGAA

SLDASCLGRLGGIAVAYFGLTTLSASALAVALAFI

IKPGSGAQTLQSSDLGLEDSGPPPVPKETVDSFLD

LARNLFPSNLVVAAFRTYATDYKVVTQNSSSGNVT

HEKIPIGTEIEGMNILGLVLFALVLGVALKKLGSE

GEDLIRFFNSLNEATMVLVSWIMWYVPVGIMFLVG

SKIVEMKDIIVLVTSLGKYIFASILGHVIHGGIVL

PLIYFVFTRKNPFRFLLGLLAPFATAFATCSSSAT

LPSMMKCIEENNGVDKRISRFILPIGATVNMDGAA

IFQCVAAVFIAQLNNVELNAGQIFTILVTATASSV

GAAGVPAGGVLTIAIILEAIGLPTHDLPLILAVDW

IVDRTTTVVNVEGDALGAGILHHLNQKATKKGEQE

LAEVKVEAIPNCKSEEETSPLVTHQNPAGPVASAP

ELESKESVL.
```

In some embodiments, a capture domain comprises the extracellular domain of SLC1A4 or a fragment or derivative thereof. In some embodiments, a capture domain comprises the extracellular domain of SLC1A4 or a fragment or derivative thereof, having an amino acid sequence of SEQ ID NO: 112. In some embodiments, a capture domain comprises a fragment of SLC1A4 or a fragment or derivative thereof, having an amino acid sequence of SEQ ID NO: 113.

In some embodiments, the capture domain comprising SLC1A4, or a fragment or derivative thereof, comprises an amino acid sequence selected from any one of SEQ ID NOs: 111-113. In some embodiments, the capture domain comprising SLC1A4, or a fragment or derivative thereof, comprises the amino acid sequence of any one of SEQ ID NOs: 111-113 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC1A4, or fragment thereof, comprises a sequence with at least 90%, at least 95%, at least 97%, or at least 99% identity to any one of SEQ ID NOs: 111-113.

In some embodiments, the capture domain binds a Nipah or Hendra virus particle. Nipah and Hendra viruses are both members of the Paramyxoviridae family and cause respiratory and nervous system disease. Nipah and Hendra viruses enter cells via the ephrin-B2 and ephrin-B3.

In some embodiments, a capture domain of a purification matrix provided herein comprises ephrin-B2, or a fragment or derivative thereof. In some embodiments, a capture domain comprising ephrin-B2 or a fragment or derivative thereof binds to a Nipah virus particle or a Hendra virus particle. Ephrin-B2 (see, e.g., Uniprot Accession No. P52799) binds promiscuously to ephrin receptors. Ephrin receptors are a family of receptor tyrosine kinases which are crucial for migration, repulsion, and adhesion during neuronal, vascular, and epithelial development. The amino acid sequence of ephrin-B2 is:

(SEQ ID NO: 114)
(M)AVRRDSVWKYCWGVLMVLCRTAISKSIVLEPI

YWNSSNSKFLPGQGLVLYPQIGDKLDIICPKVDSK

TVGQYEYYKVYMVDKDQADRCTIKKENTPLLNCAK

PDQDIKFTIKFQEFSPNLWGLEFQKNKDYYIISTS

NGSLEGLDNQEGGVCQTRAMKILMKVGQDASSAGS

TRNKDPTRRPELEAGTNGRSSTTSPFVKPNPGSST

DGNSAGHSGNNILGSEVALFAGIASGCIIFIVIII

TLVVLLLKYRRRHRKHSPQHTTTLSLSTLATPKRS

GNNNGSEPSDIIIPLRTADSVFCPHYEKVSGDYGH

PVYIVQEMPPQSPANIYYKV.

In some embodiments, a capture domain comprises the extracellular domain of ephrin-B2 or a fragment or derivative thereof. In some embodiments, a capture domain comprises the extracellular domain of ephrin-B2 or a fragment or derivative thereof, having an amino acid sequence of SEQ ID NO: 115.

In some embodiments, the capture domain comprising ephrin-B2, or a fragment or derivative thereof, comprises an amino acid sequence selected from SEQ ID NO: 114 or SEQ ID NO: 115. In some embodiments, the capture domain comprising ephrin-B2, or a fragment or derivative thereof, comprises the amino acid sequence of SEQ ID NO: 114 or SEQ ID NO: 115 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ephrin-B2, or fragment thereof, comprises a sequence with at least 90%, at least 95%, at least 97%, or at least 99% identity to SEQ ID NO: 114 or SEQ ID NO: 115.

In some embodiments, the capture domain binds a retrovirus particle. In some embodiments, the capture domain binds to Gibbon-ape leukemia virus (GaLV). GaLV is an oncogenic type C retrovirus isolated from the white-handed gibbon and wooly monkey. GaLV virus enters host cells via the sodium-dependent phosphate transporter 1 (SLC20A1) or sodium-dependent phosphate transporter 2 (SLC20A2).

In some embodiments, a capture domain of a purification matrix provided herein comprises SLC20A1, or a fragment or derivative thereof. In some embodiments, a capture domain comprising SLC20A1 or a fragment or derivative thereof binds to a GaLV virus particle. SLC20A1 (see, e.g., Uniprot Accession No. Q8WUM9) is a sodium-phosphate symporter, which confers human cells susceptibility to GaLV. The amino acid sequence of SLC20A1 is:

(SEQ ID NO: 116)
MATLITSTTAATAASGPLVDYLWMLILGFIIAFVLAFSVGANDVANSFG

TAVGSGVVTLKQACILASIFETVGSVLLGAKVSETIRKGLIDVEMYNST

QGLLMAGSVSAMFGSAVWQLVASFLKLPISGTHCIVGATIGFSLVAKGQ

EGVKWSELIKIVMSWFVSPLLSGEVISGILFFLVRAFILHKADPVPNGL

RALPVFYACTVGINLFSIMYTGAPLLGFDKLPLWGTILISVGCAVFCAL

IVWFFVCPRMKRKIEREIKCSPSESPLMEKKNSLKEDHEETKLSVGDIE

NKHPVSEVGPATVPLQAVVEERTVSFKLGDLEEAPERERLPSVDLKEET

SIDSTVNGAVQLPNGNLVQFSQAVSNQINSSGHYQYHTVHKDSGLYKEL

LHKLHLAKVGDCMGDSGDKPLRRNNSYTSYTMAICGMPLDSFRAKEGEQ

KGEEMEKLTWPNADSKKRIRMDSYTSYCNAVSDLHSASEIDMSVKAEMG

LGDRKGSNGSLEEWYDQDKPEVSLLFQFLQILTACFGSFAHGGNDVSNA

IGPLVALYLVYDTGDVSSKVATPIWLLLYGGVGICVGLWVWGRRVIQTM

GKDLTPITPSSGFSIELASALTVVIASNIGLPISTTHCKVGSVVSVGWL

RSKKAVDWRLFRNIFMAWFVTVPISGVISAAEVIAIFRYVILRM.

In some embodiments, a capture domain comprises a fragment of SLC20A1, having an amino acid sequence of any one of SEQ ID NOs: 117 and 118. In some embodiments, a capture domain comprises SLC20A1 or a fragment or derivative thereof, having an amino acid sequence of SEQ ID NO: 116 with a mutation of Asp-550 to lysine, arginine, glycine, alanine, or histidine. In some embodiments, a capture domain comprises SLC20A1 or a fragment or derivative thereof, having an amino acid sequence of SEQ ID NO: 117 with a mutation of Asp-20 to lysine, arginine, glycine, alanine, or histidine.

In some embodiments, the capture domain comprising SLC20A1, or a fragment or derivative thereof, comprises an amino acid sequence selected from any one of SEQ ID NOs: 116-118. In some embodiments, the capture domain comprising SLC20A1, or a fragment or derivative thereof, comprises the amino acid sequence of any one of SEQ ID Nos: 116-118 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC20A1, or fragment thereof, comprises a sequence with at least 90%, at least 95%, at least 97%, or at least 99% identity to any one of SEQ ID NOs: 116-118.

In some embodiments, a capture domain of a purification matrix provided herein comprises SLC20A2, or a fragment or derivative thereof. In some embodiments, a capture domain comprising SLC20A2 or a fragment or derivative thereof binds to a GaLV virus particle. SLC20A2 (see, e.g., Uniprot Accession No. Q08357) is a sodium-phosphate symporter, which confers human cells susceptibility to GaLV. The amino acid sequence of SLC20A2 is:

(SEQ ID NO: 119)
(M)AMDEYLWMVILGFITAFILAFSVGANDVANSFGTAVGSGVVTLRQA

CILASIFETTGSVLLGAKVGETIRKGIIDVNLYNETVETLMAGEVSAMV

GSAVWQLIASFLRLPISGTHCIVGSTIGFSLVAIGTKGVQWMELVKIVA

SWFISPLLSGFMSGLLFVLIRIFILKKEDPVPNGLRALPVFYAATIAIN

VFSIMYTGAPVLGLVLPMWAIALISFGVALLFAFFVWLFVCPWMRRKIT

GKLQKEGALSRVSDESLSKVQEAESPVFKELPGAKANDDSTIPLTGAAG

ETLGTSEGTSAGSHPRAAYGRALSMTHGSVKSPISNGTFGFDGHTRSDG

HVYHTVHKDSGLYKDLLHKIHIDRGPEEKPAQESNYRLLRRNNSYTCYT

```
AAICGLPVHATFRAADSSAPEDSEKLVGDTVSYSKKRLRYDSYSSYCNA

VAEAEIEAEEGGVEMKLASELADPDQPREDPAEEEKEEKDAPEVHLLFH

FLQVLTACFGSFAHGGNDVSNAIGPLVALWLIYKQGGVTQEAATPVWLL

FYGGVGICTGLWVWGRRVIQTMGKDLTPITPSSGFTIELASAFTVVIAS

NIGLPVSTTHCKVGSVVAVGWIRSRKAVDWRLFRNIFVAWFVTVPVAGL

FSAAVMALLMYGILPYV.
```

In some embodiments, a capture domain comprises the extracellular domain of SLC20A2, having an amino acid sequence of SEQ ID NO: 120. In some embodiments, a capture domain comprises SLC20A2 or a fragment or derivative thereof, having an amino acid sequence of SEQ ID NO: 119 with a mutation of Lys-522 to aspartate, glycine, alanine, glutamate, or histidine. In some embodiments, a capture domain comprises SLC20A2 or a fragment or derivative thereof, having an amino acid sequence of SEQ ID NO: 120 with a mutation of Lys-20 to aspartate, glycine, alanine, glutamate, or histidine.

In some embodiments, the capture domain comprising SLC20A2, or a fragment or derivative thereof, comprises an amino acid sequence selected from any one of SEQ ID NOs: 119-120. In some embodiments, the capture domain comprising SLC20A2, or a fragment or derivative thereof, comprises the amino acid sequence of any one of SEQ ID Nos: 119-120 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising SLC20A2, or fragment thereof, comprises a sequence with at least 90%, at least 95%, at least 97%, or at least 99% identity to any one of SEQ ID NOs: 119-120.

In some embodiments, the capture domain binds a coronavirus particle. In some embodiments, the capture domain binds to SARS-CoV-2 or SARS-CoV. SARS-CoV-2 and SARS-CoV enter host cells via angiotensin-converting enzyme 2 (ACE2).

In some embodiments, a capture domain of a purification matrix provided herein comprises ACE2, or a fragment or derivative thereof. In some embodiments, a capture domain comprising ACE2 or a fragment or derivative thereof binds to a SARS-CoV or SARS-CoV-2 virus particle. ACE2 (see, e.g., Uniprot Accession No. Q9BYF1) is a carboxypeptidase of the renin-angiotensin hormone system. The amino acid sequence of ACE2 is:

```
                                           (SEQ ID NO: 121)
(M)SSSSWLLLSLVAVTAAQSTIEEQAKTFLDKENHEAEDLEYQSSLAS

WNYNTNITEENVQNIVINNAGDKWSAFLKEQSTLAQMYPLQEIQNLTVK

LQLQALQQNGSSVLSEDKSKRLNTILNTMSTIYSTGKVCNPDNPQECLL

LEPGLNEIMANSLDYNERLWAWESWRSEVGKQLRPLYEEYVVLKNEMAR

ANHYEDYGDYWRGDYEVNGVDGYDYSRGQLIEDVEHTFEEIKPLYEHLH

AYVRAKLMNAYPSYISPIGCLPAHLLGDMWGRFWTNLYSLTVPFGQKPN

IDVTDAMVDQAWDAQRIFKEAEKFFVSVGLPNMTQGFWENSMLTDPGNV

QKAVCHPTAWDLGKGDFRILMCTKVTMDDFLTAHHEMGHIQYDMAYAAQ

PFLLRNGANEGFHEAVGEEVISLSAATPKHLKSIGLLSPDFQEDNETEI

NFLLKQALTIVGTLPFTYMLEKWRWMVFKGEIPKDQWMKKWWEMKREIV

GVVEPVPHDETYCDPASLFHVSNDYSFIRYYTRTLYQFQFQEALCQAAK

HEGPLEIKCDISNSTEAGQKLFNMLRLGKSEPWTLALENVVGAKNIVIN

VRPLLNYFEPLFTWLKDQNKNSFVGWSTDWSPYADQSIKVRISLKSALG

DKAYEWNDNEMYLFRSSVAYAMRQYFLKVKNQMILFGEEDVRVANLKPR

ISENEFVTAPKNVSDIIPRTEVEKAIRMSRSRINDAFRLNDNSLEFLGI

QPTLGPPNQPPVSIWLIVEGVVMGVIVVGIVILIFTGIRDRKKKNKARS

GENPYASIDISKGENNPGFQNTDDVQTSF.
```

In some embodiments, a capture domain comprises the extracellular domain of ACE2 or a fragment thereof. In some embodiments, a capture domain comprises the extracellular domain of ACE2 or a fragment thereof, having an amino acid sequence of any one of SEQ ID NOs: 122-124. In some embodiments, a capture domain comprises ACE2 or a fragment or derivative thereof, having an amino acid sequence of SEQ ID NO: 121 with one or more mutations selected from K419E, K419D, K419H, K419G, K419A, N89G, and N89A. In some embodiments, a capture domain comprises ACE2 or a fragment or derivative thereof, having an amino acid sequence of SEQ ID NO: 121 with one or more mutations of K31, H34, E35, N90, E208, H374, H378 to any amino acid selected from arginine, lysine, glutamic acid, aspartic acid, histidine, alanine, glycine, serine, threonine, and tryptophan.

In some embodiments, a capture domain comprises ACE2 or a fragment or derivative thereof, having an amino acid sequence of SEQ ID NO: 122 with one or more mutations selected from K403E, K403D, K403H, K403G, K403A, N73G, and N73A. In some embodiments, a capture domain comprises ACE2 or a fragment or derivative thereof, having an amino acid sequence of SEQ ID NO: 123 with one or more mutations selected from K402E, K402D, K402H, K402G, K402A, N72G, and N72A. In some embodiments, a capture domain comprises ACE2 or a fragment or derivative thereof, having an amino acid sequence of SEQ ID NO: 124 with a mutation of N72G or N72A.

In some embodiments, the capture domain comprising ACE2, or a fragment or derivative thereof, comprises an amino acid sequence selected from any one of SEQ ID NOs: 121-124. In some embodiments, the capture domain comprising ACE2, or a fragment or derivative thereof, comprises the amino acid sequence of any one of SEQ ID Nos: 121-124 with at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25 or more amino acid mutations. In some embodiments, the capture domain comprising ACE2, or fragment thereof, comprises a sequence with at least 90%, at least 95%, at least 97%, or at least 99% identity to any one of SEQ ID NOs: 121-124.

In some embodiments, the biologic has a size from about 0.001 μm to about 500 μm in diameter or length. In some embodiments, the biologic has a diameter between 1 nm and 100 μm, inclusive of the endpoints. In some embodiments, the biologic has a diameter between 1 nm and 100 nm, inclusive of the endpoints. In some embodiments, the biologic has a diameter between 100 nm and 1 μm, inclusive of the endpoints. In some embodiments, the biologic has a diameter between 1 μm and 50 μm, inclusive of the endpoints. In some embodiments, the biologic has a diameter between 50 μm and 100 μm, inclusive of the endpoints.

In some embodiments, the size (i.e., diameter or length) of the biologic is about 0.001 μm, about 0.002 μm, about 0.003 μm, about 0.004 μm, about 0.005 μm, about 0.006 μm, about 0.007 μm, about 0.008 μm, about 0.009 μm, about 0.010 μm, about 0.020 µm, about 0.030 µm, about 0.040 µm, about 0.050 µm, about 0.060 µm, about 0.070 µm, about 0.080 µm, about 0.090 µm, about 0.1 µm, about 0.2 µm, about 0.3 µm, about 0.4 µm, about 0.5 µm, about 0.6 µm, about 0.7 µm, about 0.8 µm, about 0.9 µm, about 1 µm, about 2 µm, about 3 µm, about 4 µm, about 5 µm, about 6 µm, about 7 µm, about 8 µm, about 9 µm, about 10 µm, about 11 µm, about 12 µm, about 13 µm, about 14 µm, about 15 µm, about 16 µm, about 17 µm, about 18 µm, about 19 µm, about 20 µm, about 21 µm, about 22 µm, about 22 µm, about 23 µm, about 24 µm, about 25 µm, about 26 µm, about 27 µm, about 28 µm, about 29 µm, about 30 µm, about 31 µm, about 32 µm, about 33 µm, about 34 µm, about 35 µm, about 36 µm, about 37 µm, about 38 µm, about 39 µm, about 40 µm, about 41 µm, about 42 µm, about 43 µm, about 44 µm, about 45 µm, about 46 µm, about 47 µm, about 48 µm, about 49 µm, about 50 µm, about 55 µm, about 60 µm, about 65 µm, about 70 µm, about 75 µm, about 80 µm, about 85 µm, about 90 µm, about 95 µm, about 100 µm, about 150 µm, about 200 µm, about 250 µm, about 300 µm, about 350 µm, about 400 µm, about 450 µm, or about 500 µm, or greater, including all values and ranges in between. In some embodiments, the biologic has a size of greater than or equal to 10 µm. In some embodiments, the biologic has a size that is greater than or equal to 25 µm. In some embodiments, the biologic has a size that is greater than or equal to 50 µm. In some embodiments, the biologic has a size that is greater than or equal to 100 µm.

In some embodiments, the biologic has a size (i.e., molar mass) from about 2 kDa to about 1000 MDa. In some embodiments, the biologic has a molar mass of about 2 kDa, about 5 kDa, about 15 kDa, about 20 kDa, about 20 kDa, about 25 kDa, about 30 kDa, about 35 kDa, about 40 kDa, about 45 kDa, about 50 kDa, about 55 kDa, about 60 kDa, about 65 kDa, about 70 kDa, about 75 kDa, about 80 kDa, about 85 kDa, about 90 kDa, about 95 kDa, about 100 kDa, about 150 kDa, about 200 kDa, about 250 kDa, about 300 kDa, about 350 kDa, about 400 kDa, about 450 kDa, about 500 kDa, about 550 kDa, about 600 kDa, about 650 kDa, about 700 kDa, about 750 kDa, about 800 kDa, about 850 kDa, about 900 kDa, about 950 kDa, about 1000 kDa, about 1 MDa, about 5 MDa, about 10 MDa, about 15 MDa, about 20 MDa, about 25 MDa, about 50 MDa, about 75 MDa, about 100 MDa, about 125 MDa, about 150 MDa, about 175 MDa, about 200 MDa, about 225 MDa, about 250 MDa, about 275 MDa, about 300 MDa, about 325 MDa, about 350 MDa, about 400 MDa, about 425 MDa, about 450 MDa, about 500 MDa, about 550 MDa, about 600 MDa, about 650 MDa, about 700 MDa, about 750 MDa, about 800 MDa, about 850 MDa, about 900 MDa, about 950 MDa, or about 1000 MDa, including all values and ranges therebetween.

In some embodiments, the capture domain comprises an amino acid sequence selected from the group consisting of:

(a)
(SEQ ID NO: 24)
VDNKFNKEQQNAFYEILHLPNLNEEQRNAFIQSLK

DDPSQSANLLAEAKKLNDAQAPK;

(b)
(SEQ ID NO: 25)
VDNKFNKEQQNAFYEILSLPNLNEEQRAAFIQSLK

DDPSQSANLLAEAKKLNDAQAPKG (c)
(SEQ ID NO: 26)
VDNKFNKEHQNAFYEILHLPNLNEEQRNAFIQSLK

HDPSQSANLLAEAKKLNDAQAPKG;

(d)
(SEQ ID NO: 27)
AQHDEAQQNAFYQVLNMPNLNADQRNGFIQSLKDD

PSQSANVLGEAQKLNDSQAPKADAQQNKFNKDQQ

SAFYEILNMPNLNEEQRNGFIQSLKDDPSQSTNV

LGEAKKLNESQAPKADNNFNKEQQNAFYEILNMP

NLNEEQRNGFIQSLKDDPSQSANLLAEAKKLNES

QAPKADNKFNKEOQNAFYEILHLPNLNEEQRNGF

IQSLKDDPSQSANLLAEAKKLNDAQAPKADNKFN

KEQQNAFYEILHLPN;

(e)
(SEQ ID NO: 28)
TYKLILNGKTLKGETTTEAVDAATAEKVFKQYAND

NGVDGEWTYDDATKTFTVTEG;

(f)
(SEQ ID NO: 29)
KTDTYKLILNGKTLKGETTTEAVDAATAEKVFKQY

ANDNGVDGEWTYDDATKTFTVTEKPEVIDASELT

PAVTTYKLVINGKTLKGETTTKAVDAETAEKAFK

QYANDNGVDGVWTYDDATKTFTVTEMVTEVPGDA

PTEPEKPEASIPLVPLTPATPIAKDDAKKDDTKK

EDAKKPEAKKDDAKKAET;

(g)
(SEQ ID NO: 30)
KEETPETPETDSEEEVTIKANLIFANGSTQTAEFK

GTFEKATSEAYAYADTLKKDNGEYTVDVADKGYT

LNlKFAG;

(h)
(SEQ ID NO: 31)
GYVS(R/H/K)(R/HXP/S);

(i)
(SEQ ID NO: 32)
SDVQLQESGPDLVKPSQSLSLTCTVTGYSITSGYT

WHWIRQFPGNKQEWGYIHFSGYTNYNPSLKSRVS

ITRDTSKNQFFLHLNSVTTEDTATYYCARGDYGY

EWFTYWGQGTLVTVSADIQMTQSSSSFSVSLGDR

VTITCKASEDIHNRLAWYKQKPGNAPRLLISGAT

SLETGVPSRFSGSGSGKDYTLSITSLQNEDVATY

YCQQYWIGPFTFGSGTNLEIK j)
(SEQ ID NO: 33)
GYVSRHPGGGC;

(k)
(SEQ ID NO: 34)
GYVSRHPGGGS;

(l)
(SEQ ID NO: 35)
FHENWPSGGGC;

(m)
(SEQ ID NO: 36)
FHENWPSGGGS;

(n)

GVVTINP; (SEQ ID NO: 37)

(o)

GLVTPSG; (SEQ ID NO: 38)

(p)

GYVSHRS; (SEQ ID NO: 39)

(q)

KVWILTP; (SEQ ID NO: 40)

(r)

KLWVIPQ (SEQ ID NO: 41)

(s)

(SEQ ID NO: 42)
GVSAGESVQITLPKNEVQLNAYVLQEPPKGETYTY

DWQLITHPRDYSGEMEGKHSQILKLSKLTPGLYEF

KVIVEGQNAHGEGYVNVTVKPEPRKNRPPIAIVSP

QFQEISLPTTSTVIDGSQSTDDDKIVQYHWEELKG

PLREEKISEDTAILKLSKLVPGNYTFSLTVVDSDG

ATNSTTANLTVNKAVDYPPVANAGPNQVITLPQNS

ITLFGNQSTDDHGITSYEWSLSPSSKGKVVEMQGV

RTPTLQLSAMQEGDYTYQLTVTDTIGQQATAQVTV

IVQPENNKPPQADAGPDKELTLPVDSTTLDGSKSS

DDQKIISYLWEKTQGPDGVQLENANSSVATVTGLQ

VGTYVFTLTVKDERNLQSQSSVNVIVKEEINKPPI

AKITGNVVITLPTSTAELDGSKSSDDKGIVSYLWT

RDEGSPAAGEVLNHSDHHPILFLSNLVEGTYTFHL

KVTDAKGESDTDRTTVEVKPDPRG (t)

(SEQ ID NO: 43)
SAGESVQITLPKNEVQLNAYVLQEPPKGETYTYDW

QLITHPRDYSGEMEGKHSQILKLSKLTPGLYEFKV

IVEGQNAHGEGYVNVTVKPE (u)

(SEQ ID NO: 44)
IAIVSPQFQEISLPTTSTVIDGSQSTDDDKIVQYH

WEELKGPLREEKISEDTAILKLSKLVPGNYTFSLT

VVDSDGATNSTTANLTVNKA (v)

(SEQ ID NO: 45)
MGVSAGESVQITLPKNEVQLNAYVLQEPPKGETYT

YDWQLITHPRDYSGEMEGKHSQILKLSKLTPGLYE

FKVIVEGQNAHGEGYVNVTVKPEPRKNRPPIAIVS

PQFQEISLPTTSTVIDGSQSTDDDKIVQYHWEELK

GPLREEKISEDTAILKLSKLVPGNYTFSLTVVDSD

GATNSTTANLTVNKA (w)

(SEQ ID NO: 46)
VANAGPNQVITLPQNSITLFGNQSTDDHGITSYEW

SLSPSSKGKVVEMQGVRTPTLQLSAMQEGDYTYQL

TVTDTIGQQATAQVTVIVQPE (x)

(SEQ ID NO: 47)
QADAGPDKELTLPVDSTTLDGSKSSDDQKIISYLW

EKTQGPDGVQLENANSSVATVTGLQVGTYVFTLTV

KDERNLQSQSSVNVIVKEE (y)

(SEQ ID NO: 48)
IAKITGNVVITLPTSTAELDGSKSSDDKGIVSYLW

TRDEGSPAAGEVLNHSDHHPILFLSNLVEGTYTFH

LKVTDAKGESDTDRTTVEVKPDP,
and (z)

(SEQ ID NO: 49)
LAEAKVLANRELDKYGVSDYYKNLINNAKTVEGVK

ALIDEILAALP.

In some embodiments, the capture domain comprises an amino acid sequence selected from any one of SEQ ID Nos: 24-49,62-148, 167-171. In some embodiments, the capture domain comprises an amino acid sequence with at least 90%, at least 95%, at least 96%, at least 97%, at least 98%, at least 99% identity to any one of SEQ ID Nos: 24-49, 62-148, and 167-171.

In some embodiments, the capture domain comprises an amino acid sequence lacking the N-terminal methionine of any one of SEQ ID Nos: 24-49, 62-148, and 167-171.

In some embodiments, the capture domain binds a contaminant. In some embodiments, the contaminant is a biologic. In some embodiments, the contaminant is selected from the group consisting of a solvent, an endotoxin, a protein, a peptide, a nucleic acid, a virus, and a carbohydrate.

In some embodiments, the capture domain comprises a signal peptide.

In some embodiments, the number of capture domains within a protein-based purification matrix ranges from 1 to about 100. In some embodiments, the number of capture domains is about 1, about 5, about 10, about 20, about 30, about 40, about 50, about 55, about 60, about 65, about 70, about 75, about 80, about 85, about 90, about 95, or about 100. In some embodiments, a single polypeptide with phase behavior may be coupled to multiple capture domains, such as about 1 to 100 capture domains.

In some embodiments, a protein-based purification matrix may have two or more capture domains that each individually bind to different biologics, contaminants, or other molecules.

In some embodiments, the affinity of a capture domain for a biologic, contaminant, and/or other molecule is modulated to facilitate separation of the biologic from the protein-based purification matrix.

In some embodiments, the capture domain is selected from the group consisting of protein A, protein G, and protein L, or a fragment or derivative thereof. In some embodiments, the capture domain is an antibody or fragment thereof (e.g., a Fab). In some embodiments, the antibody fragment thereof is a single-chain variable fragment.

Polypeptides with Phase Behavior

The compositions and methods disclosed herein may employ one or more polypeptides with phase behavior.

In some embodiments, the polypeptide with phase behavior is a resilin-like polypeptide (RLP). Resilin-like polypeptides are elastomeric polypeptides with mechanical properties including desirable resilience, compressive elastic modulus, tensile elastic modulus, shear modulus, extension to break, maximum tensile strength, hardness, rebound, and compression set. In some embodiments, the resilin-like polypeptides described herein are polymers which comprise one or more repeats. In some embodiments, the polymeric repeats may have an amino acid sequence selected from any one of SEQ ID NOS: 1-9.

In some embodiments, a resilin-like polypeptide comprises more than one type of repeat, e.g. a repeat of SEQ ID NO: 1 and a repeat of SEQ ID NO: 3.

In some embodiments, the resilin-like polypeptides described herein comprise repeats that occur up to 500 times within a given RLP. In some embodiments, the repeats occur about 1, about 2, about 3, about 4, about 5, about 6, about 7, about 8, about 9, about 10, about 20, about 30, about 40, about 50, about 60, about 70, about 80, about 90, about 100, about 110, about 120, about 130, about 140, about 150, about 160, about 170, about 180, about 190, about 200, about 210, about 220, about 230, about 240, about 250, about 260, about 270, about 280, about 290, about 300, about 310, about 320, about 330, about 340, about 350, about 360, about 370, about 380, about 390, about 400, about 450, or about 500 times.

In some embodiments, the RLP comprises one or more partial repeats. In some embodiments, the length of a partial repeat is 1, 2, 3, 4, 5, 6, 7, 8, 9, 10, or more amino acids. In some embodiments, the RLP comprises one or more additional amino acids at the N-terminus or C-terminus of the RLP that are not part of a repeat.

In some embodiments, one or more RLP repeats are scrambled, i.e., they contain a different amino acid sequence but retain the same amino acid composition. For example, a repeat may have a different amino acid sequence than SEQ ID NO: 8, but retain the same amino acid composition.

In some embodiments, the polypeptide with phase behavior is an elastin-like polypeptide. Elastin-like polypeptides (ELPs) are biopolymers derived from tropoelastin. In some embodiments, the elastin-like polypeptides described herein are polymers comprising a pentapeptide repeat having the sequence (Val-Pro-Gly-Xaa-Gly)$_n$ (SEQ ID NO: 189). In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, the pentapeptide repeat is scrambled, for example it comprises a different amino acid sequence but maintains the same amino acid composition. For example, an ELP may comprise a different amino acid sequence than SEQ ID NO: 189, but maintains the same amino acid composition, e.g. 40% of the sequence is glycine, 20% of the sequence is Xaa, 20% of the sequence is proline, and 20% of the sequence is valine.

In some embodiments, the ELP comprises one or more partial repeats. In some embodiments, the length of a partial repeat is 1, 2, 3, or 4 amino acids. In some embodiments, the ELP comprises one or more additional amino acids at the N-terminus or C-terminus of the ELP that are not part of a repeat.

ELPs and RLPs undergo a phase transition in response to an environmental factor. ELPs and RLPs retain their ability to undergo a phase transition when coupled to one or more polypeptides (such as one or more capture domains), or expressed as a fusion protein with one or more other polypeptides (such as one or more capture domains). Polymers like ELPs and RLPs exhibit a transition temperature ($T_t$), also referred to as a cloud point temperature ($T_c$). In some embodiments ELPs and RLPs undergo a reversible phase transition from a soluble to an insoluble phase at the $T_t$. ELPs that transition from a soluble to an insoluble phase with heating or an increase in salt concentration have a $T_t$ referred to as a lower critical solution temperature (LCST). RLPs that transition from a soluble to an insoluble phase with cooling or a decrease in salt concentration have a $T_t$ referred to as a lower critical solution temperature (UCST). In some embodiments, the phase transition results from a change in secondary structure of the ELP and/or RLP. For example, the phase transition of an ELP results from a change in secondary structure from a random coil (below the $T_t$) to a type II β-turn. In some embodiments, the change in secondary structure is characterized by a method selected from circular dichroism spectropolarimetry, small angle x-ray scattering, and cryo-electron microscopy, ultraviolet-visible spectrophotometry, static light scattering, dynamic light scattering, nuclear magnetic resonance spectroscopy, solid-state nuclear magnetic resonance spectroscopy, infrared spectroscopy, Fourier transform infrared spectroscopy (FTIR), microscopy, and small angle neutron scattering. In some embodiments, the phase transition of an ELP does not result from a chance in secondary structure.

In some embodiments, the RLPs and ELPs described herein have a transition temperature between about 0° C. and about 100° C. In some embodiments, the RLPs and ELPs described herein have a transition temperature between about 10° C. and about 50° C. In some embodiments the transition temperature is about 0° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., about 40° C., about 41° C., about 42° C., about 43° C., about 44° C., about 45° C., about 46° C., about 47° C., about 48° C., about 49° C., about 50° C., about 51° C., about 52° C., about 53° C., about 54° C., about 55° C., about 56° C., about 57° C., about 58° C., about 59° C., about 60° C., about 61° C., about 62° C., about 63° C., about 64° C., about 65° C., about 66° C., about 67° C., about 68° C., about 69° C., about 70° C., about 71° C., about 72° C., about 73° C., about 74° C., about 75° C., about 76° C., about 77° C., about 78° C., about 79° C., about 80° C., about 81° C., about 82° C., about 83° C., about 84° C., about 85° C., about 86° C., about 87° C., about 88° C., about 89° C., about 90° C., about 91° C., about 92° C., about 93° C., about 94° C., about 95° C., about 96° C., about 97° C., about 98° C., about 99° C., or about 100° C. In some embodiments, the RLPs described herein have a transition temperature from about 10° C. to about 100° C.

In some embodiments, the $T_t$ of the RLPs and ELPs described herein is modulated by manipulating the primary structure e.g. amino acid sequence of the RLP and ELP. In some embodiments, the hydrophobicity of the ELP or RLP is modulated. In some embodiments, the hydrophobicity of the ELP is modified by altering the identity of the guest residue Xaa. In some embodiments, the hydrophobicity of the ELP or RLP is increased resulting in a decreased $T_t$. In some embodiments, the hydrophobicity of the ELP or RLP is decreased resulting in an increased $T_t$. In some embodiments, the polarity of the ELP or RLP is modulated. In some embodiments, the polarity of the ELP is modulated by altering the identity of the guest residue Xaa. In some embodiments, the polarity of the ELP or RLP is increased resulting in an increased $T_t$. In some embodiments, the polarity of the ELP or RLP is decreased resulting in a decreased $T_t$.

In some embodiments, the number of ELP pentapeptide repeats (n) is modulated to alter the $T_t$. In some embodiments, n of the pentapeptide repeat (Val-Pro-Gly-Xaa-Gly)$_n$ (SEQ ID NO: 189) is an integer from 1 to 500, inclusive of endpoints. In some embodiments, n is 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, or 500, including all values and ranges in between.

In some embodiments, Xaa also referred to herein as "the guest residue" is any amino acid that does not eliminate the phase behavior of the ELP. In some embodiments, Xaa is any amino acid except proline. In some embodiments, Xaa is independently selected for each repeat. For example, a given ELP may contain the guest residues alanine, glycine, and valine at a ratio of 8:7:1. In some embodiments Xaa is selected from the group consisting of alanine, arginine, asparagine, aspartic acid, cysteine, glutamic acid, glutamine, glycine, histidine, isoleucine, leucine, lysine, methionine, phenylalanine, praline, serine, threonine, tryptophan, tyrosine and valine. In some embodiments, Xaa is a non-classical amino acid selected from Table 2 and/or the group consisting of 2,4-diaminobutyric acid, α-amino-isobutyric acid, alloisoleucine, 4-aminobutyric acid, 2-amino butyric acid (Abu), γ-Abu, ε-Ahx, 6-amino hexanoic acid, 2-amino isobutyric acid (Aib), 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, β-alanine, fluoro-amino acids, designer amino acids such as β-methyl amino acids, Cα-methyl amino acids, Nα-methyl amino acids, and amino acid analogs in general. In some embodiments, Xaa is the D-isomer of a natural or non-classical amino acid.

In some embodiments, the $T_t$ of the RLPs and ELPs described herein is modulated by introducing one or more environmental factors to the composition containing the RLP and/or ELP. In some embodiments, the $T_t$ of the ELPs and/or RLPs is modulated by adjusting the ionic strength of solvents. In some embodiments, the ionic strength of the solvent is adjusted by adding salt. In some embodiments, ELPs and/or RLPs contain lower $T_t$ in solvents containing anions categorized as kosmotropes. Anions that are kosmotropes are highly hydrated and influence the water shield on ELPs and/or RLPs. In some embodiments, the $T_t$ of ELPs and/or RLPs can be adjusted through the addition of anions that are chaotropes. At low concentrations, the addition of chaotropes increase the $T_t$ of the ELP and/or RLP. At high concentrations, the addition of a chaotrope decreases the $T_t$ of the ELP and/or RLP. In some embodiments, the $T_t$ of the ELP and/or RLP can be tuned by introducing one or more reagents that disrupts hydrogen bonds. Non-limiting examples of reagents that disrupt hydrogen bonds include sodium dodecyl sulfate (SDS) and urea. In some embodiments, reagents that enhance hydrogen bond formation are utilized to modulate the $T_t$. In some embodiments, reagents that enhance hydrophobic interactions are utilized to modulate the $T_t$. Trifluoroethanol is a reagent which enhances both hydrophobic interactions and hydrogen bond formation, causing a decrease in $T_t$.

In some embodiments, the ELP and/or RLP concentration can be adjusted to modulate $T_t$. In some embodiments, a higher ELP and/or RLP concentration results in a reduced $T_t$. In some embodiments, a lower ELP and/or RLP concentration results in an increased $T_t$.

In addition, modulation of pH, light, and ion concentrations also can be utilized to modulate $T_t$.

In some embodiments, modulation of the number of (e.g. addition or removal) charged amino acids (e.g. histidine, lysine, arginine, glutamic acid, aspartic acid, ornithine, or other non-natural charged amino acids) and identity (e.g. positively or negatively charged) enables tuning of the $T_t$ through pH modulation.

In some embodiments, the ELPs and/or RLPs described herein are block copolymers. A block copolymer comprises two or more sequence domains or blocks, in which two or more blocks contain different properties. Non-limiting examples of properties that can be tuned include hydrophilicity, hydrophobicity, polarity, and secondary structure. In some embodiments, the block copolymer is an amphiphile, e.g. it comprises at least one hydrophobic and at least one hydrophilic block.

In some embodiments, the ELPs and/or RLPs described herein assemble into various morphologies. Non-limiting examples of morphologies include a spherical aggregate, a micelle, a vesicle, a fibril, a nanofibril, a nanotube, and a hydrogel. In some embodiments, the RLPs and/or ELPs described herein assemble into various morphologies after the addition of an environmental factor. In some embodiments, the RLPs and/or ELPs described herein change from one morphology to another morphology after the addition of an environmental factor. In some embodiments, the RLPs and/or ELPs described herein change from one morphology to another morphology after the addition of a biologic.

In some embodiments, addition of an environmental factor causes an RLP and/or ELP to undergo a phase transition. In some embodiments, at the RLP and/or ELP phase transition, the RLP and/or ELP converts from one morphology to another morphology.

In some embodiments, a phase transition of an RLP and/or ELP causes the formation of dense, liquid, droplets.

In some embodiments, the polypeptide with phase behavior comprises an amino acid sequence selected from the group consisting of:

(a)
(GRGDSPY)$_n$ (SEQ ID NO: 1)

(b)
(GRGDSPH)$_n$ (SEQ ID NO: 2)

(c)
(GRGDSPV)$_n$ (SEQ ID NO: 3)

(d)
(GRGDSPYG)$_n$ (SEQ ID NO: 4)

(e)
(RPLGYDS)$_n$ (SEQ ID NO: 5)

(f)
(RPAGYDS)$_n$ (SEQ ID NO: 6)

(g)
(GRGDSYP)$_n$ (SEQ ID NO: 7)

(h)
(GRGDSPYQ)$_n$ (SEQ ID NO: 8)

(i)
(GRGNSPYG)$_n$ (SEQ ID NO: 9)

(j)
(GVGVP)$_n$; (SEQ ID NO: 11)

(k)
(GVGVPGLGVPGVGVPGLGVPGVGVP)$_m$; (SEQ ID NO: 12)

(l)
(GVGVPGVGVPGAGVPGVGVPGVGVP)$_m$; (SEQ ID NO: 13)

(m)
(GVGVPGWGVPGVGVPGWGVPGVGVP)$_m$; (SEQ ID NO: 14)

(n)
(GVGVPGVGVPGVGVPGVGVPGVGVPGV GVPGEGVPGFGVPGVGVP)$_m$; (SEQ ID NO: 15)

(o)
(GVGVPGVGVPGVGVPGVGVPGVGVPGVG VPGKGVPGFGVPGVGVP)$_m$; and (SEQ ID NO: 16)

(p)
(GAGVPGVGVPGAGVPGVGVPGAGVP)$_m$; (SEQ ID NO: 17)

or a randomized, scrambled analog thereof;
wherein:
n is an integer in the range of 1-500, inclusive of endpoints; and
m is an integer in the range of 4-25, inclusive of endpoints.

In some embodiments, the polypeptide with phase behavior comprises an amino acid sequence of (GVGVPGVGVP-GAGVPGVGVPGVGVP)$_m$ (SEQ ID NO: 53) or (GVGVPGVGVPGLGVPGVGVPGVGVP)$_m$ (SEQ ID NO: 55), wherein m is an integer between 2 and 32, inclusive of endpoints. In some embodiments, the polypeptide with phase behavior comprises an amino acid sequence of (GVGVPGVGVPGAGVPGVGVPGVGVP)$_m$ (SEQ ID NO: 193), wherein m is 8 or 16. In some embodiments, the polypeptide with phase behavior comprises an amino acid sequence of (GVGVPGAGVP)$_m$ (SEQ ID NO: 54), wherein m is an integer between 5 and 80, inclusive of endpoints. In some embodiments, the polypeptide with phase behavior comprises an amino acid sequence of (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

In some embodiments, the polypeptide with phase behavior comprises an amino acid sequence selected from (a)
(GVGVP)$_m$; (SEQ ID NO: 52)

(b)
(ZZPXXXGZ)$_m$; (SEQ ID NO: 57)

(c)
(ZZPXGZ)$_m$; (SEQ ID NO: 58)

(d)
(ZZPXXGZ)$_m$; and (SEQ ID NO: 59)

(e)
(ZZPXXXGZ)$_m$, (SEQ ID NO: 60)

wherein m is an integer between 10 and 160, inclusive of endpoints, wherein X if present is any amino acid except proline or glycine, and wherein Z if present is any amino acid.

In some embodiments, the polypeptide with phase behavior comprises an amino acid sequence of (GVGVP)$_m$ (SEQ ID NO: 192), wherein m is 20, 40, or 80. In some embodiments, the polypeptide with phase behavior comprises an amino acid sequence of (GRGDXPZX)$_m$ (SEQ ID NO: 61) or (XZPXDGRG)$_m$ (SEQ ID NO: 51), wherein X is glutamine or serine, Z is tyrosine or valine, and m is an integer between 10 and 160, inclusive of endpoints.

In some embodiments, the polypeptide with phase behavior comprises a first set of repeat sequences and a second set of repeat sequences. The first set of repeat sequences and the second set of repeat sequences may each individually comprise sequences that are repeated one or more times. In some embodiments, the first set of repeat sequences any/or the second set of repeat sequences comprises a repeating sequence comprising any one of SEQ ID NOs: 1-17 and 51-61. In some embodiments, the polypeptide with phase behavior comprises a first set of repeat sequences and a second set of repeat sequences, wherein the first set of repeat sequences comprises the amino acid sequence of (GRGDXPZX)$_{40}$ (SEQ ID NO: 149) and the second set of repeat sequences comprises the amino acid sequence (GVGVP)$_{80}$ (SEQ ID NO: 150), wherein X is glutamine and Z is tyrosine. In some embodiments, polypeptide with phase behavior comprising a first set of repeat sequences and a second set of repeat sequences comprises the sequence of SEQ ID NO: 151 In some embodiments, the polypeptide with phase behavior comprises at least one, at least two, at least three, at least four, at least five, at least six, at least seven, at least eight, at least nine, or at least ten different sets of repeat sequences. In some embodiments, each set of repeat sequences within the polypeptide with phase behavior comprises sequences that repeat from about 5 to about 400 times, for example, about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 155, about 160, about 165, about 170, about 175, about 180, about 185, about 190, about 195, about 200, about 205, about 210, about 215, about 220, about 225, about 230, about 235, about 240, about 245, about 250, about 255, about 260, about 265, about 270, about 275, about 280, about 285, about 290, about 295, about 300, about 305, about 310, about 315, about 320, about 325, about 330, about 335, about 340, about 345, about 350, about 355, about 360, about 365, about 370, about 375, about 380, about 385, about 390, about 395, or about 400 times.

In some embodiments, the polypeptide with phase behavior comprising an amino acid sequence selected from any one of SEQ ID NOs: 1-17 and 51-61 also comprises up to 10 additional N-terminal and/or C-terminal amino acids. In some embodiments, the polypeptide with phase behavior comprising an amino acid sequence of any one of SEQ ID NOs: 1-17 and 51-61 also comprises an additional N-terminal methionine. In some embodiments, the polypeptide with phase behavior comprising an amino acid sequence of any one of SEQ ID NOs: 1-17 and 51-61 also comprises an additional C-terminal glycine.

In some embodiments, the polypeptide with phase behavior has the same amino acid composition of an ELP and/or RLP but does not contain repeats. In some embodiments, the polypeptide with phase behavior comprises an amino acid sequence that is 80%, about 85%, about 90%, about 95%, about 96%, about 97%, about 98%, about 99%, or about 100% identical to an ELP and/or RLP. In some embodiments, the polypeptide with phase behavior comprises an amino acid composition that is 80%, about 85%, about 90%, about 95%, about 96%, about 97%, about 98%, about 99%, or about 100% identical to an ELP and/or RLP. In some embodiments, the polypeptide with phase behavior comprises a composition of hydrophobic amino acids that is 80%, about 85%, about 90%, about 95%, about 96%, about 97%, about 98%, about 99%, or about 100% identical to an ELP and/or RLP.

In some embodiments, the polypeptide with phase behavior comprises a non-repetitive unstructured polypeptide. In some embodiments, the non-repetitive unstructured polypeptide has an amino acid sequence that contains at least 50 amino acids. In some embodiments, the non-repetitive unstructured polypeptide has an amino acid sequence that contains at least 50, at least 60, at least 70, at least 80, at least 90, or at least 100 amino acids. In some embodiments, the sequence of the non-repetitive unstructured polypeptide is at least about 10% proline (e.g. at least 10%, 20%, 30%, 40%, 50%, 60%, 70%, or 80%) and at least 20% glycine (e.g. at least 20%, at least 30%, at least 40%, at least 50%, at least 60%, at least 70%, at least 80%, or at least 90%). In some embodiments, the non-repetitive unstructured polypeptide has a sequence that contains at least about 40% of amino acids selected from the group consisting of valine, alanine, leucine, lysine, threonine, isoleucine, tyrosine, serine, and phenylalanine.

In some embodiments, the non-repeated unstructured polypeptide comprises a sequence that does not contain three contiguous identical amino acids, wherein any 5-10 amino acid subsequence does not occur more than once in the non-repeated unstructured polypeptide, and wherein when the non-repeated unstructured polypeptide comprises a subsequence starting and ending with proline, and wherein the subsequence further comprises at least one glycine.

In some embodiments, the ELPs and/or RLPs described herein are expressed as a component of a fusion protein. In some embodiments, the fusion protein is expressed in bacteria or mammalian cells. In some embodiments, the fusion protein is expressed in *Escherichia coli*. In some embodiments, the fusion protein is expressed in insect cells. In some embodiments, the sequence of the non-repetitive unstructured polypeptide is at least about 10% proline (e.g. at least 10%, 20%, 30%, 40%) and at least 20% glycine (e.g. at least 20%, 30%, 40%, or 50%), and at least 40% (e.g. at least 40%, 50%, 60%, or 70%) of amino acids selected from the group consisting of valine, alanine, leucine, lysine, threonine, isoleucine, tyrosine, serine, and phenylalanine.

In some embodiments, the non-repetitive unstructured polypeptide does not contain three contiguous identical amino acids. In some embodiments, the non-repetitive unstructured polypeptide comprises a subsequence (e.g. a fragment of the non-repetitive unstructured polypeptide) which only occurs once in the non-repetitive unstructured polypeptide sequence. In some embodiments, the non-repetitive unstructured polypeptide comprises a subsequence that starts and ends with proline. In some embodiments, the non-repetitive unstructured polypeptide comprises a subsequence that contains at least one glycine.

In some embodiments, the polypeptide with phase behavior comprises a signal peptide.

In some embodiments, the polypeptide with phase behavior comprises an amino acid sequence of (GVGVPGLGVPGVGVPGLGVPGVGVP)$_m$ (SEQ ID NO: 191), wherein m is 16. In some embodiments, the polypeptide with phase behavior comprises an amino acid sequence of SEQ ID NO: 164. In some embodiments, the polypeptide with phase behavior comprises an amino acid sequence of SEQ ID NO: 165.

Linkers between Polypeptides with Phase Behavior and Capture Domains

In some embodiments, the capture domain is coupled to the polypeptide with phase behavior via a linker. In some embodiments, any linker that does not interfere with the function of the purification matrix may be utilized.

In some embodiments, the linker connects the capture domain to the polypeptide with phase behavior. In some embodiments, the linker enables cooperative interactions between the polypeptide with phase behavior and the capture domain. In some embodiments, the linker is a peptide. In some embodiments, the linker preserves the phase behavior of the polypeptide with phase behavior. In some embodiments, the linker preserves the $T_t$ of the polypeptide with phase behavior. In some embodiments, the linker preserves the structure of the capture domain. In some embodiments, the linker comprises between 1 and 50 amino acids. In some embodiments, the linker comprises 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids.

In some embodiments, the stiffness of the linker is increased by the inclusion of proline in the linker amino acid sequence.

In some embodiments, the flexibility of a linker is increased by the inclusion of small polar amino acids, including threonine, serine, and glycine.

In some embodiments, the linker may adopt various secondary structures, including but not limited to α-helices, β-strands, and random coils. In some embodiments, the linker adopts an α-helix and comprises an amino acid repeat of (EAAAK)$_n$ (SEQ ID NO: 18) where n is a repeat number, i.e., an integer in the range of 1 to 20, inclusive of endpoints.

In some embodiments, the linker is comprised of (G4S)$_n$ (SEQ ID NO: 19) where n can be an integer from 1 to 30 (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30). In embodiments, the polypeptide linker has a repeat of (SGGG)n (SEQ ID NO: 20), wherein n is an integer from 1 to 50 (e.g. 1, 2, 3, 4, 5, 6, 7, 8, 9, 10, 11, 12, 13, 14, 15, 16, 17, 18, 19, 20). In embodiments, the polypeptide linker has a repeat of (GGGS)$_n$ (SEQ ID NO: 21), wherein n is an integer from 1 to 20 (e.g. 1, 2, 3, 4, 5, 6, 7, 8, 9, 10, 11, 12, 13, 14, 15, 16, 17, 18, 19, or 20).

In some embodiments, the linker has an amino acid sequence of KESGSVSSEQLAQFRSLD (SEQ ID NO: 22). In some embodiments, the linker has an amino acid sequence of EGKSSGSGSESKST (SEQ ID NO: 23). In some embodiments, the linker only contains glycine.

In some embodiments, the peptide linker comprises a protease cleavage site. In some embodiments, the protease cleavage site is a furin cleavage site.

In some aspects, the polypeptide linker is a poly-(Gly)$_n$ linker, wherein n is an integer from 1 to 30 (e.g., 1, 2, 3, 4, 5, 6, 7, 8, 9, 10, 15, 16, 17, 18, 19, 20, 21, 22, 23, 24, 25, 26, 27, 28, 29, or 30 (SEQ ID NO: 50). In other embodiments, the linker is selected from the group consisting of: dipeptides, tripeptides, and quadripeptides. In embodiments, the linker is a dipeptide selected from the group consisting of alanine-serine (AS), leucine-glutamic acid (LE), and serine-arginine (SR).

In some embodiments, the linker is selected from GKSSGSGSESKS (SEQ ID NO: 152), GST-SGSGKSSEGKG (SEQ ID NO: 153), GST-SGSGKSSEGSGSTKG (SEQ ID NO: 154), GST-SGSGKPGSGEGSTKG (SEQ ID NO: 155), EGKSSGSGSESKEF (SEQ ID NO: 156), SRSSG (SEQ ID NO: 157), and SGSSC (SEQ ID NO: 158).

In some embodiments, the linker is a self-cleaving peptide. In some embodiments, the self-cleaving peptide is a 2A peptide. 2A peptides are a class of 18-22 amino acid long peptides that induce ribosomal skipping during translation of a protein in a cell. In some embodiments, the 2A peptide is a T2A peptide having an amino acid sequence of EGRGSLLTCGDVEENPGP (SEQ ID NO: 159), a P2A peptide having an amino acid sequence of ATNFSLLKQAGDVEENPGP (SEQ ID NO: 160), an E2A peptide having an amino acid sequence of QCTNYALLKLAGDVESNPGP (SEQ ID NO: 161), or an F2A peptide having an amino acid sequence of VKQTLNFDLLKLAGDVESNPGP (SEQ ID NO: 162). In some embodiments, the 2A peptide has at least 80%, at least 85%, at least 90%, at least 95%, or at least 98% identity to any one of SEQ ID NOs. 159-162. In some embodiments, the 2A peptide further comprises GSG (SEQ ID NO: 163) on its N-terminus.

In some embodiments, the linker is a chemical linker. In some embodiments, the chemical linker is selected from the group consisting of a carbohydrate linker, a lipid linker, a fatty acid linker, and a polyether linker.

In some embodiments, the linker is a direct covalent linkage between an amino acid residue of the polypeptide with an amino acid residue of the polypeptide with phase behavior and a capture domain. In some embodiments, a fusion protein comprises the polypeptide with phase behavior and a capture domain. In some embodiments, the fusion protein further comprises one or more linkers as described herein. In some embodiments, a fusion protein comprises, from N-terminus to C-terminus, a polypeptide with phase behavior, a linker, and a capture domain. In some embodiments, a fusion protein comprises, from N-terminus to C-terminus, a capture domain, a linker, and a polypeptide with phase behavior.

Environmental Factors

In some embodiments, one or more environmental factors are applied to cause a change of a complex comprising the protein-based purification matrix and biologic, contaminant, and/or other molecule. In some embodiments, the one or more environmental factors cause the size of a complex comprising the protein-based purification matrix and biologic, contaminant, and/or other molecule to increase. In some embodiments, the one or more environmental factors cause the polypeptide with phase behavior to aggregate. In some embodiments, the one or more environmental factors causes separation of the protein-based purification matrix from the biologic, contaminant, and/or small molecule. In some embodiments, the one or more environmental factors enables the biologic, contaminant, and/or other molecule to retain its native structure, function, and activity.

In some embodiments, the environmental factor is a change in temperature. In some embodiments, the temperature is increased about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C. In some embodiments, the temperature is decreased about 0.5° C., about 1° C., about 2° C., about 3° C., about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., about 37° C., about 38° C., about 39° C., or about 40° C.

In some embodiments, the environmental factor is a change in pH. In some embodiments, the pH is increased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units.

In some embodiments, the pH is decreased by about 0.1, about 0.2, about 0.3, about 0.4, about 0.5, about 0.6, about 0.7, about 0.8, about 0.9, about 1.0, about 1.1, about 1.2, about 1.3, about 1.4, about 1.5, about 1.6, about 1.7, about 1.8, about 1.9, about 2.0, about 2.1, about 2.2, about 2.3, about 2.4, about 2.5, about 2.6, about 2.7, about 2.8, about 2.9, about 3.0, about 3.1, about 3.2, about 3.3, about 3.4, about 3.5, about 3.6, about 3.7, about 3.8, about 3.9, about 4.0, about 4.1, about 4.2, about 4.3, about 4.4, about 4.5, about 4.6, about 4.7, about 4.8, about 4.9, about 5.0, about 5.1, about 5.2, about 5.3, about 5.4, about 5.5, about 5.6, about 5.7, about 5.8, about 5.9, or about 6.0 units.

In some embodiments, the environmental factor is change in ionic strength. In some embodiments, the change in ionic strength is brought about by increasing the concentration of salt. In some embodiments, the change in ionic strength is brought about by decreasing the concentration of salt. Non-limiting examples of salts include sodium chloride, potassium chloride, ammonium chloride, sodium acetate, sodium citrate, copper sulfate, sodium iodide, ammonium sulfate, and sodium sulfate. In some embodiments, dialysis is used to change the concentration of salt in the composition containing the protein-based purification matrix and biologic, contaminant, and/or other molecule.

In some embodiments, the environmental factor is the addition of a cofactor. Non-limiting examples of cofactors include calcium, magnesium, cobalt, copper, zinc, iron, manganese, selenium, molybdenum, potassium, coenzyme A (CoA), a nucleoside triphosphate, and a vitamin. In some embodiments, the cofactor is calcium. In some embodiments, the nucleoside triphosphate is adenosine triphosphate, uridine triphosphate, guanosine triphosphate, cytidine triphosphate, or thymidine triphosphate. In some embodiments, the vitamin is a fat-soluble. In some embodiments, the vitamin is water-soluble. Non-limiting examples of vitamins include vitamin A, vitamin B1 (thiamine), vitamin B2 (riboflavin), vitamin B3 (niacin or niacinamide), vitamin B5 (pantothenic acid), Vitamin B6 (pyridoxine, pyridoxal, or pyridoxamine, or pyridoxine hydrochloride), vitamin B7 (biotin), vitamin B9 (folic acid), vitamin B12, vitamin C, vitamin D, Vitamin E, vitamin K, K1, and K2, folic acid, and biotin.

In some embodiments, the environmental factor is a change in the concentration of the protein-based purification matrix. In some embodiments, the environmental factor is a change in the concentration of the biologic, contaminant, and/or other molecule.

In some embodiments, the environmental factor is a change in pressure of the composition containing the protein-based purification matrix and biologic, contaminant, and/or other molecule. In some embodiments, a change in pressure can be effected by increasing or decreasing the volume of the composition.

In some embodiments, the environmental factor is the addition of one or more surfactants. In some embodiments, the one or more surfactants are selected from free fatty acid salts, soaps, fatty acid sulfonates, such as sodium lauryl sulfate, ethoxylated compounds, such as ethoxylated propylene glycol, lecithin, polygluconates, quaternary ammonium salts, lignin sulfonates, 3-((3-cholamidopropyl)dimethylammonio)-1-propanesulfonate (CHAPS), sugars, including sucrose and glucose, Triton X-100, and NP-40. In some embodiments, the surfactant is anionic, nonionic, or amphoteric.

In some embodiments, the environmental factor is the addition of one or more molecular crowding agents. Non-limiting examples of molecular crowding agents include polyethylene glycol, dextran, and ficoll. PEGS may include PEG400, PEG1450, PEG3000, PEG8000, and PEG10000.

In some embodiments, the environmental factor is the addition of one or more oxidizing agents. Non-limiting examples of oxidizing agents include hydrogen peroxide, hydrophilically or hydrophobically activated hydrogen peroxide, preformed peracids, monopersulfate or hypochlorite.

In some embodiments, the environmental factor is the addition of one or more reducing agents. In some embodiments, the one or more reducing agents is selected from the group consisting of dithiothreitol (DTT), 2-mercaptoethanol (BME), Tris (2-carboxyethyl) phosphine (TCEP), hydrazine, boron hydrides, amine boranes, lower alkyl substituted amine boranes, triethanolamine, and N,N,N',N'-tetramethylethylenediamine (TEMED).

In some embodiments, the environmental factor is the addition of one or more denaturing agents. Non-limiting examples of denaturing agents include urea, guanidine hydrochloride, guanidine, sodium salicylate, dimethyl sulfoxide, and propylene glycol.

In some embodiments, the environmental factor is the addition of one or more enzymes. Non-limiting examples of enzymes include proteases, kinases, phosphatases, synthetases, transferases, nucleases such as restriction endonucleases, lyases, isomerases, dehydrogenases, decarboxylases, and lipases.

In some embodiments, the environmental factor is the application of electromagnetic waves. In some embodiments, the environmental factor is the application of light. In some embodiments, the electromagnetic waves have a wavelength between about 0.0001 nm and about 100 m. In some embodiments, the electromagnetic waves are selected from the group consisting of gamma rays, x-rays, ultraviolet, visible, infrared, and radio waves. In some embodiments, the electromagnetic waves are gamma rays. In some embodiments, the gamma rays have a wavelength between about 0.0001 nm and about 0.01 nm, e.g. 0.0001 nm, 0.0005 nm, 0.001 nm, 0.002 nm, 0.003 nm, 0.004 nm, 0.005 nm, 0.006 nm, 0.007 nm, 0.008 nm, 0.009 nm, and 0.01 nm. In some embodiments, the x-rays have a wavelength between about 0.01 nm and 10 nm, e.g. about 0.01 nm, 0.02 nm, 0.03 nm, 0.04 nm, 0.05 nm, 0.06 nm, 0.07 nm, 0.08 nm, 0.09 nm, 0.10 nm, 0.2 nm, 0.3 nm, 0.4 nm, 0.5 nm, 0.6 nm, 0.7 nm, 0.8 nm, 0.9 nm, 1 nm, 2 nm, 3 nm, 4 nm, 5 nm, 6 nm, 7 nm, 8 nm, 9 nm, or about 10 nm. In some embodiments, the ultraviolet radiation has a wavelength between about 10 nm about 400 nm, e.g. about 10 nm, about 20 nm, about 30 nm, about 40 nm, about 50 nm, about 60 nm, about 70 nm, about 80 nm, about 90 nm, about 100 nm, about 150 nm, about 200 nm, about 250 nm, about 280 nm, about 300 nm, about 350 nm, or about 400 nm. In some embodiments, the visible waves have a wavelength of between about 400 nm and about 800 nm, e.g. about 400 nm, about 450 nm, about 500 nm, about 550 nm, about 600 nm, about 650 nm, about 700 nm, about 750 nm, or about 800 nm. In some embodiments, the infrared radiation has a wavelength of between about 800 nm and about 0.1 cm, e.g. about 800 nm, about 1 μm, about 2 μm, about 3 μm, about 4 μm, about 5 μm, about 6 μm, about 7 μm, about 8 μm, about 9 μm, about 10 μm, about 20 μm, about 30 μm, about 40 μm, about 50 μm, about 60 μm, about 70 μm, about 80 μm, about 90 μm, about 100 μm, about 200 μm, about 300 μm, about 400 μm, about 500 μm, about 600 μm, about 700 μm, about 800 μm, about 900 μm, or about 0.1 cm. In some embodiments, the radio waves has a wavelength of between about 0.1 cm and 100 m, e.g. about 0.1 cm, about 1 cm, about 10 cm, about 100 cm, about 1000 cm, about 2000 cm, about 3000 cm, about 4000 cm, about 5000 cm, about 6000 cm, about 7000 cm, about 8000 cm, about 9000 cm, or about 100 m.

In some embodiments, the environmental factor is the application of acoustic waves. In some embodiments, the acoustic waves have a frequency between about 1 Hz and 2000 kHz. In some embodiments, the acoustic waves have a frequency of about 1 Hz, about 5 Hz, about 10 Hz, about 20 Hz, about 30 Hz, about 40 Hz, about 50 Hz, about 60 Hz, about 70 Hz, about 80 Hz, about 90 Hz, about 100 Hz, about 200 Hz, about 300 Hz, about 400 Hz, about 500 Hz, about 600 Hz, about 700 Hz, about 800 Hz, about 900 Hz, about 1 kHz, about 100 kHz, about 200 kHz, about 300 kHz, about 400 kHz, about 500 kHz, about 600 kHz, about 700 kHz, about 800 kHz, about 900 kHz, about 1000 kHz, about 1100 kHz, about 1200 kHz, about 1300 kHz, about 1400 kHz, about 1500 kHz, about 1600 kHz, about 1700 kHz, about 1800 kHz, about 1900 kHz, or about 2000 kHz.

Examples

Example 1. Development of Protein-Based Purification Matrices that Exhibit Phase Behavior and Bind to a Biologic A protein-based purification matrix is generated and characterized. Initially, an expression vector comprising a sequence encoding a capture domain that binds to the Fc region of an antibody and a sequence encoding a polypeptide with phase behavior (e.g., an ELP) is generated. A fusion protein comprising the capture domain and polypeptide with phase behavior is expressed in *Escherichia coli* according to standard protocols. Isothermal titration calorimetry is utilized to characterized the affinity of the fusion protein for pure human immunoglobulin G (IgG). The transition temperature of the fusion protein is determined using UV-Vis spectrophotometry.

Example 2. Utilization of Protein-Based Purification Matrices that Exhibit Phase Behavior and Bind to a Biologic to Purify Protein The protein-based purification matrix of Example 1 is utilized to purify an antibody such as trastuzumab (Herceptin®). Various molar ratios of protein-based purification matrix to biologic (e.g. trastuzumab) are tested to determine an optimal ratio for purification (i.e., for complete capture of the biologic). An environmental factor (e.g., addition of salt such as sodium chloride or ammonium sulfate) is applied to the composition containing the protein-based purification matrix and the biologic to cause the protein-based purification matrix increase in size.

Both tangential flow filtration and centrifugation are utilized to separate the biologic from the protein-based purification matrix. Although both centrifugation and tangential flow filtration enable separation of the biologic from the protein-based purification matrix, tangential flow filtration is preferred because it enables the rapid purification of thousands of liters of sample volume without the requirement for specialized centrifuges.

TFF is performed using standard conditions—for example, a 1.5 bar transmembrane pressure and a 960 L/m²/h cross flow rate. Standard TFF membranes are used, such as a 0.1 μm hydrophilized poly(vinylidene difluoride) (PVDF) or a 0.2 μm polyethersulfone membrane.

The pH is adjusted (for example to an acidic pH such as 2-4.5, or pH 3) to separate (i.e. elute) the protein-based purification matrix from the biologic. The purity of the biologic is characterized by size exclusion chromatography. The protein-based purification matrix is then re-used for an additional round of purification.

Example 3. Utilization of Protein-Based Purification Matrices that Exhibit Phase Behavior and Bind to a Biologic to Purify Cell A protein-based purification matrix is utilized to purify T cells. The capture domain of the protein-based purification matrix specifically binds to T cells, for example, by recognizing a T-cell specific surface marker such as CD3, CD4, or CD8. Various molar ratios of protein-based purification matrix to T cell are tested to determine an optimal ratio for purification. Various environmental factors are tested, such as different salts and salt concentrations, to determine the most efficacious way of isolating T cells.

Tangential flow filtration and/or centrifugation and/or continuous centrifugation are utilized to separate the T cell from the protein-based purification matrix.

Example 4. Purification of AAV9 Using a Purification Matrix and Tangential Flow Filtration (TFF)

HEK293 cells producing a recombinant AAV9 vector packaging a tdTomato transgene were grown in suspension and harvested by centrifugation. 200 mL of the supernatant were treated with 10 U/mL benzonase and 0.01% pluronic acid and sterile filtered through a 0.2-micron bottle-top filter. This starting material (SM) was then mixed with 1 μM purification matrix having an amino acid sequence of SEQ ID NO: 172 and 0.6 M NaCl salt (i.e., the first environmental factor) to form an AAV-purification matrix complex.

Figure 2:
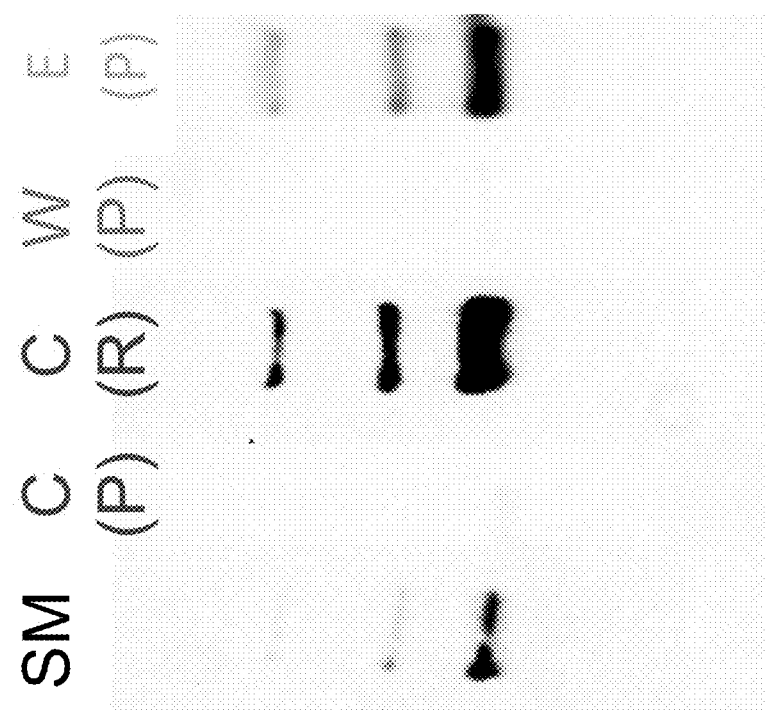
FIG. 2 is a western blot, which shows the presence or absence of VP1, VP2, and VP3 proteins of AAV, at different steps of the tangential flow filtration (TFF) process. The first lane, labeled SM (starting material) shows the presence of AAV particles in the starting material. The SM is supernatant from cultured HEK293 cells producing a recombinant AAV9 vector packaging a tdTomato transgene that is treated with 10 U/mL benzonase and 0.01% pluronic acid. The second lane, labeled C (P), shows the absence of AAV particles in the permeate. The third lane, labeled C (R), shows the presence of AAV particles in the retentate. The fourth lane, labeled W(P), shows the absence of AAV particles in the wash containing removed contaminants. The fifth lane, labeled E(P), shows the eluted AAV particles.
Figure 3:
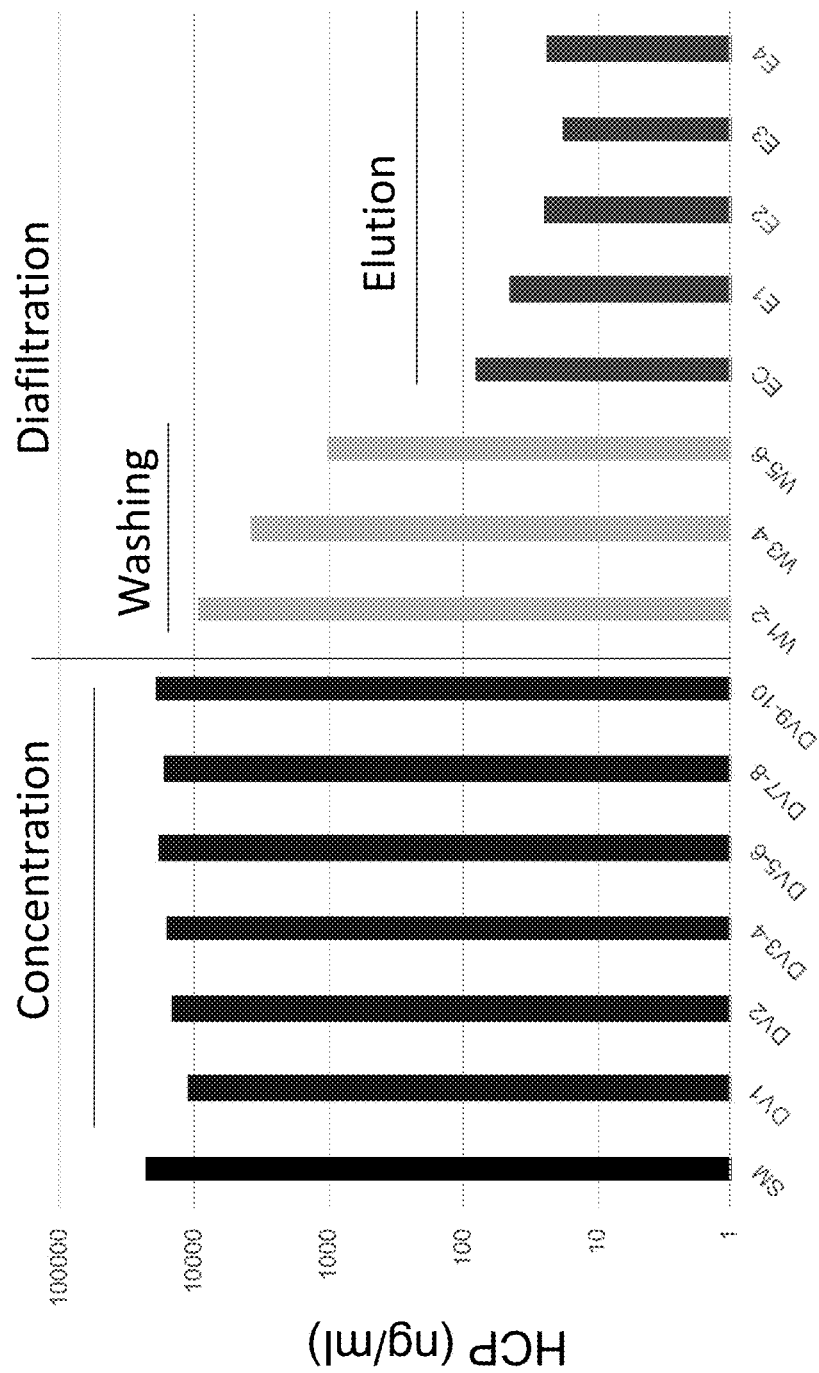
FIG. 3 is a graph showing quantitation of contaminant host cell proteins (HCP) within a composition containing an AAV-purification matrix complex during TFF concentration and diafiltration. The composition containing the AAV-purification matrix complex is referred to as SM or "starting material" and contains AAV9 particles. Throughout the concentration and diafiltration stages of TFF, 1 mL fractions are collected. DV1, DV2, DV3-4, DV5-6, DV7-8, and DV9-10 refer to fractions collected during the concentration stage of TFF. W1-2, W3-4, and W5-6 refer to fractions collected during the washing stage of diafiltration. EC, E1, E2, E3, and E4 refer to fractions collected during the elution stage of diafiltration.
Figure 4:
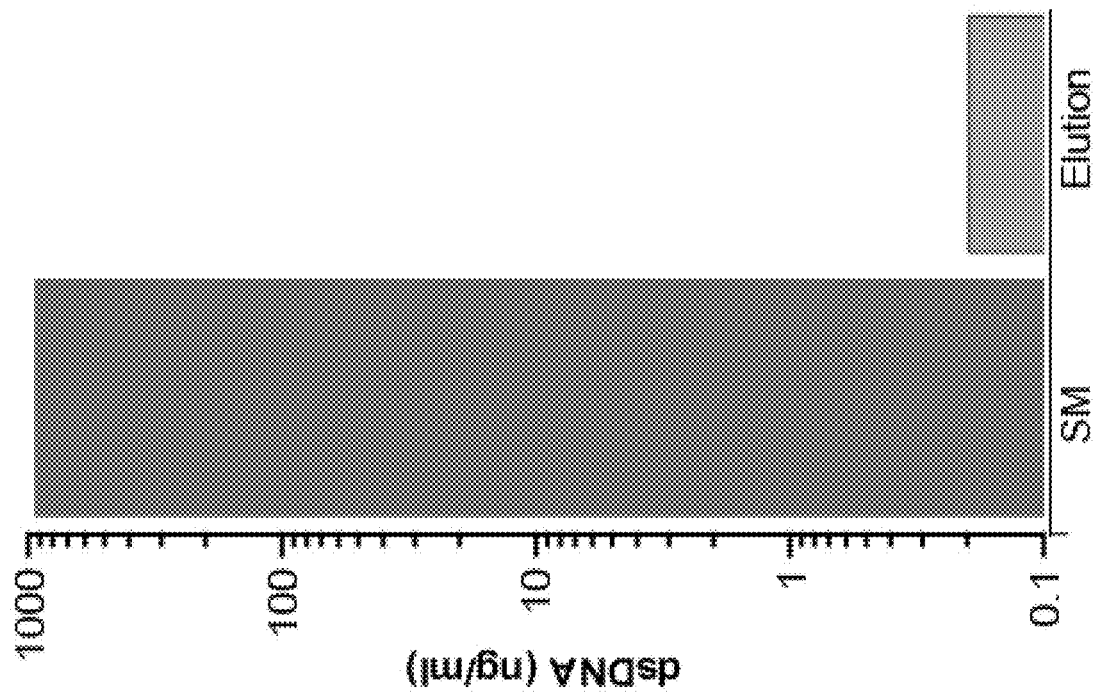
FIG. 4 is a graph showing the concentration of double stranded DNA (dsDNA) impurities in a composition comprising AAV9 particles before purification with a purification matrix (referred to as starting material (SM)) and after purification with a purification matrix (referred to as "elution").

This SM was processed in continuous fed-batch mode using a Repligen KR2i tangential-flow filtration (TFF) unit. The TFF was setup with a 20 mL retentate vessel, prepared with 50 μM purification matrix and 0.6 M NaCl, as well as a 13 cm² hollow fiber filter with 0.2-micron pores. A concentration-diafilter (CD) mode (10× concentration factor (CF), 6× diavolumes (DV) was run in permeate control with the SM and permeate pump set to equal flow rates. Once the entire 200 mL SM feed was processed, the retained material was rinsed with 6 DV of wash buffer (20 mM Tris, 0.5M NaCl). The AAV9 material, now substantially free of contaminants, was then resolubilized on ice and mixed with an equal volume of 2× Elution buffer (i.e., a second environmental factor) with the permeate valve closed. The elution buffer contained 100 mM glycine at pH 3 and 0.6 M NaCl. After 20 minutes, the recirculating sample was warmed back to room temperature and phase separated with NaCl. The permeate valve was opened and pure AAV9 was collected in a second CD mode (2× CF, 4× DV) with elution buffer diavolumes (100 mM glycine, pH 3, 0.6M NaCl). The flux and transmembrane pressure (TMP) were tracked throughout the run (FIG. 1), demonstrating a stable, efficient, and scalable process. Permeate and retentate samples were collected throughout the run for analysis of AAV loss by anti-AAV Western Blot (FIG. 2), as well as purity by host cell protein (HCP) quantification using a HEK HCP ELISA (Cygnus®) and dsDNA quantification using a Quant-iT™ Picogreen Assay® (Thermo Fisher®) The process enabled removal of HCPs by 2-3 log (FIG. 3) and of double stranded DNA (dsDNA) by >3 log (FIG. 4).

Example 5. Effect of Titer, Clarification, and Nuclease Treatment on AAV Purification The ability of purification matrix having an amino acid sequence of SEQ ID NO: 172 to capture AAV8 particles from cell lysate or the media of suspension cultures of HEK293 cells producing AAV8 particles (referred to in FIG. 10 as "supernatant") was tested.

A cell lysate was produced by resuspending pelleted HEK293 cells producing AAV8 particles in 0.5% Triton-X-100. The cell lysate and media evaluated contained titers of AAV particles that ranged from $1\times10^8$ to $1\times10^7$ viral particles per microliter (vp/µL). The ability of purification matrix to capture AAV8 particles from cell lysate treated with nuclease was also evaluated. Cell lysates that were treated with nuclease were incubated for 1 hr at 34° C. with 50 U/mL benzonase (Millipore®).

The ability of purification matrix to capture AAV8 particles from clarified cell lysate or media was also evaluated. Cell lysates and/or media were clarified by centrifugation at 13,200 rpm for 10 minutes. The supernatant was used for subsequent isolation of the AAV8 particles for 10 min at 13,200 rpm.

AAV8 particles were isolated from each sample by mixing the sample with 10 µM purification matrix and 0.6 M NaCl (i.e., a first environmental factor) and centrifuging the sample at 13,200 rpm for 10 minutes.

The pellets containing AAV-purification matrix complex were resuspended on ice in an elution buffer (i.e., second environmental factor) comprising 100 mM glycine at pH 3, warmed to room temperature, transitioned with 0.6 M salt, and then centrifuged a second time. The amount of eluted AAV8 was compared to that in the starting material, (i.e the media or cell lysate comprising AAV8 particles) using inverted terminal repeat (ITR) quantitative polymerase chain reaction (qPCR). This technique quantitates the number of AAV particles by measuring the number of ITRs using PCR. The AAV Capture Efficiency for each sample was calculated using the following equation: 100×(# of AAV8 particles captured by the purification matrix/# of AAV8 particles in the composition before purification).

Figure 5:
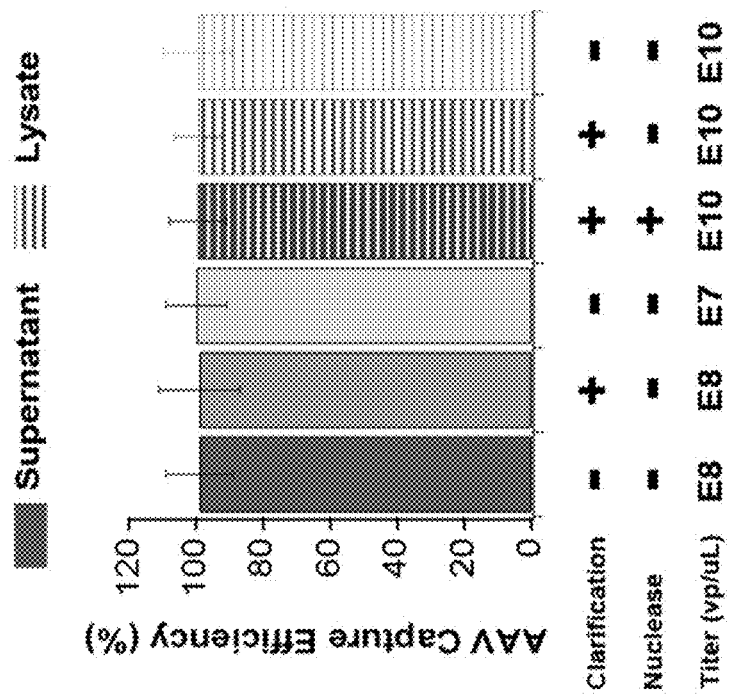
FIG. 5 is a graph that shows a purification matrix's efficiency in capturing AAV particles (AAV Capture Efficiency) after clarification and/or treatment with nuclease. The compositions comprising AAV8 particles included compositions from the cell lysate of HEK293 cells producing AAV8 particles, referred to as "lysate," and compositions comprising media harvested from HEK293 cells producing AAV8 particles, referred to as "supernatant". The compositions contained viral titers of $1\times10^7$ viral particles per microliter (vp/uL) (referred to as "E7"), $1\times10^8$ vp/uL ("E8"), or $1\times10^{10}$ vp/uL ("E10"). The compositions were clarified (+) or not clarified (−). The compositions were exposed to nuclease (+) or not exposed to nuclease (−). A purification matrix was used to capture AAV8 particles from each composition. The AAV Capture Efficiency for each sample was calculated using the following equation: 100×(# of AAV8 particles captured by the purification matrix/# of AAV8 particles in the composition before purification).
Figure 6:
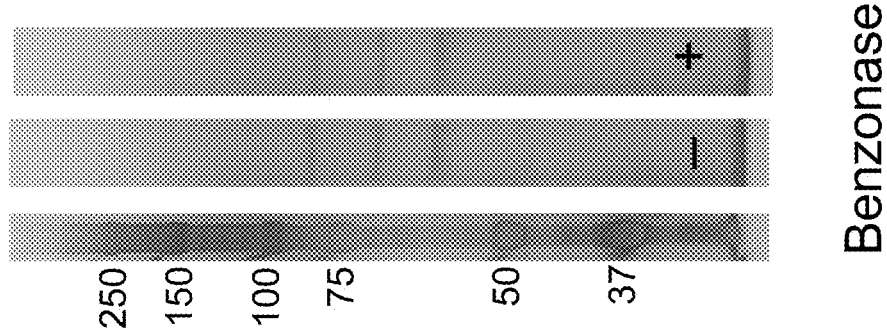
FIG. 6 provides an image of a silver stained SDS-PAGE gel, which shows that purification of AAV8 particles with purification matrix yields highly pure AAV8 particles, regardless of pre-treatment with benzonase nuclease. (−) indicates no pre-treatment with benzonase nuclease was performed, and (+) indicates that pre-treatment was performed. The first lane shows molecular weight markers (kDa).
Figure 7:
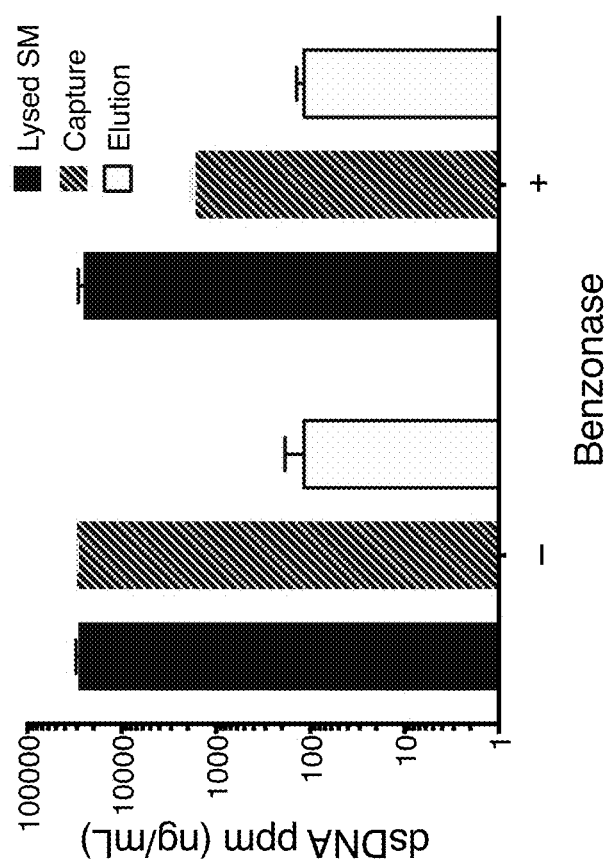
FIG. 7 is a graph that shows dsDNA concentration in AAV8 samples with (+) or without (−) benzonase nuclease pre-treatment. With or without pre-treatment, the compositions comprising purified AAV8 eluted from the purification matrix had similar levels of dsDNA, as assessed by Quant-iT picogreen assay. Lysed SM: starting material comprised of clarified cell lysate; Capture: purification matrix capture step supernatant; Elution: purification matrix elution step supernatant.

The purification matrix robustly captured >98% AAV particles regardless of titer ($1\times10^7$ to $4\times10^{10}$), clarification, nuclease treatment, or lysate versus media as the starting material (FIG. 5). Evaluation of lysate samples with and without nuclease treatment showed that nuclease treatment did not impact final eluted AAV8 particle purity when compared by silver stain SDS-PAGE (FIG. 6) and Quant-iT™ picogreen assay for dsDNA (FIG. 7).

Example 6. Effect of Centrifugation Speed on AAV8 Capture

Figure 8:
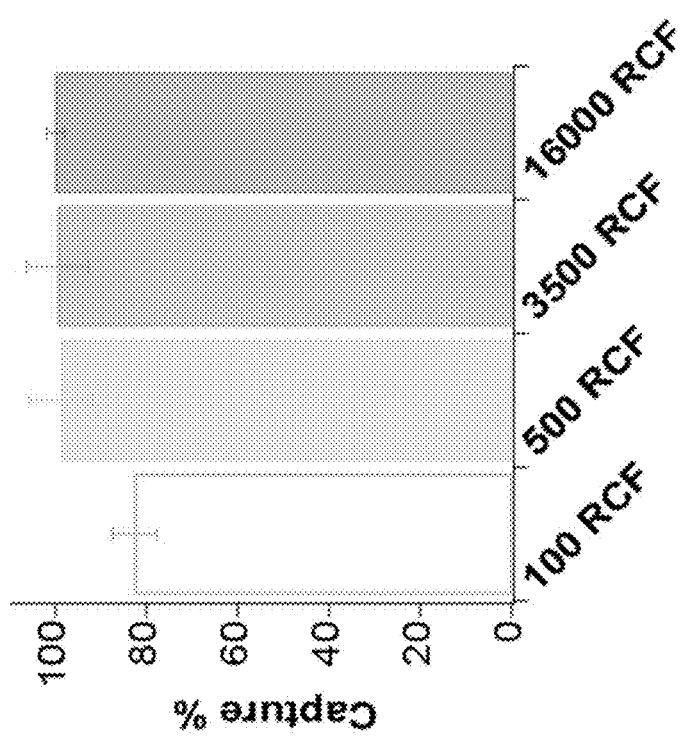
FIG. 8 shows AAV Capture Efficiency after centrifugation at various speeds. The figure shows that >95% capture of AAV8 particles is achieved using centrifugation speeds at or greater than 500 relative centrifugal force (RCF), including 3500 and 16000 RCF.

Harvested media from AAV8 HEK293 suspension cell culture was mixed with 10 of Purification Matrix having an amino acid sequence of SEQ ID NO: 172 and 0.6 M NaCl to form an AAV-purification matrix complex. The samples were centrifuged for 10 min at relative centrifugal forces (RCF) ranging from 100 to 16,000. For each RCF, uncaptured AAV8 remaining in the supernatant was quantified using ITR qPCR and calculated as a percentage of the amount measured in the starting harvest material. The AAV Capture Efficiency was measured as 100% less the percentage remaining uncaptured in the supernatant and results showed that speeds of 500 RCF or higher yielded highly efficient AAV8 capture (FIG. 8).

Example 7. Stabilization of AAV2 by Purification Matrix

Figure 9:
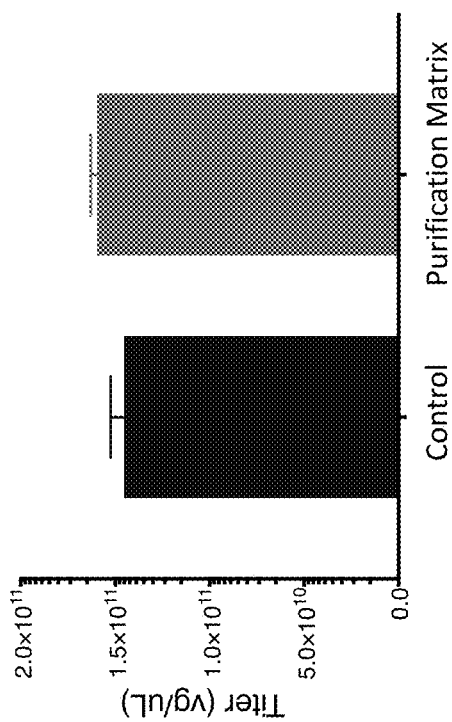
FIG. 9 shows a comparison of the AAV2 titers produced by HEK293 cell cultures under standard conditions (control) or with the addition of purification matrix as quantified by inverted terminal repeat (ITR) quantitative polymerase chain reaction (qPCR) The data shows that the presence of purification matrix may increase titers by 8% or more. Student's t-test, p=0.077.

Adherent HEK293 cells were transfected according to a standard triple transfection method, and used to produce recombinant AAV2 particles carrying a luciferase transgene. The cells were cultured for 6 days, in the presence or absence of purification matrix having an amino acid sequence of SEQ ID NO: 172. Cells cultured in the presence of 10 µM purification matrix were compared to control cells, with each group, treatment or control, in triplicate. The culture media was collected on day 4 and replaced with an equal volume of media with or without the purification matrix additive. On day 6, the media was collected again and the cells were rinsed with PBS and harvested by scraping. The total vector genomes collected in all fractions were quantified for comparison using qPCR using primers against ITR2. Inclusion of the purification matrix in the culture media increased vector genome (vg) titers by at least 8% (FIG. 9).

Example 8. Stabilization of AAV8 by Purification Matrix

Figure 10:
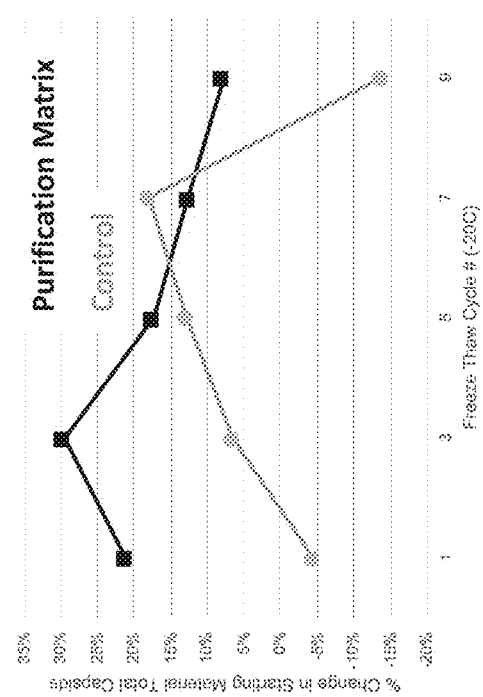
FIG. 10 shows the percent change of total AAV8 capsids after repeated freeze-thaw cycles in a composition comprising AAV8 particles and purification matrix and a composition comprising AAV8 particles and PBS (negative control).

Media was harvested from HEK293 cells grown in suspension, wherein the cells were producing GFP-AAV8. The media was aliquoted and stored at −20° C. either with or without the addition of 100 µM of purification matrix having an amino acid sequence of SEQ ID NO: 172. As an accelerated stability study, the samples were subjected to freeze-thaw cycles (−20° C. to room temperature) and then assayed using an AAV8 ELISA (Progen), which quantifies total intact AAV particles. The quantified particles for the control and purification matrix-treated samples were normalized to the starting materials with no freeze-thaws. This data indicates that the purification matrix may enhance the resistance of AAV particles to freeze-thaw-mediated degradation and aggregation (FIG. 10).

Example 9. Capture of AAV8 Particles with a Purification Matrix

Figure 11:
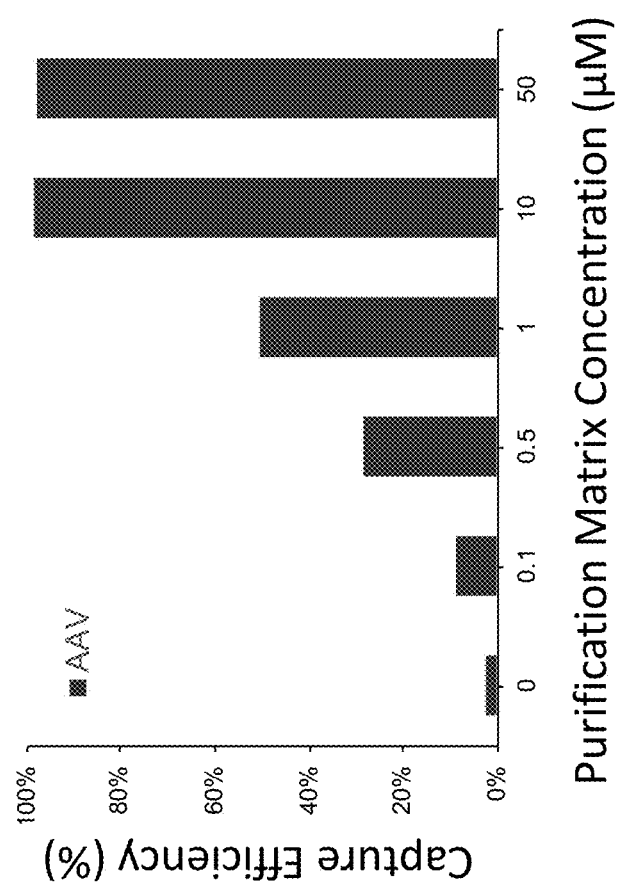
FIG. 11 is a graph showing the effect of purification matrix concentration on the Capture Efficiency of AAV8 particles. The Capture Efficiency was calculated using the following equation: 100×(# of AAV8 particles captured by the purification matrix/# of AAV8 particles in the composition before purification).

Media was harvested from HEK293 suspension cells producing AAV8 particles carrying a luciferase (luc) transgene. The media was contacted with 0 µM, 0.1 µM, 0.5 µM, 1 µM, 10 µM, and 50 µM purification matrix having an amino acid sequence of SEQ ID NO: 172, resulting in the formation of complexes between AAV8 particles and purification matrix. A first environmental factor (i.e. 0.6 M NaCl) was applied to increase the size of the complexes. Subsequently, the media containing the complexes was centrifuged at 13,200 revolutions per minute (rpm) for 10 minutes (min). This protocol allowed for separation of the complexes from impurities on the basis of size. Inverted terminal repeat (ITR) quantitative polymerase chain reaction (qPCR) was utilized to evaluate the amount of AAV particles captured from the media using the purification matrix compared to the amount of AAV particles in the starting material. This technique quantitates the number of AAV particles by measuring the number of ITRs using PCR. The Capture Efficiency of the purification matrix at each concentration was calculated using the following equation: 100×(# of AAV8 particles captured by the purification matrix/# of AAV8 particles in the composition before purification). FIG. 11 shows that purification matrix concentrations at or above 10 µM are sufficient for robust, >98%, virus capture.

Example 10. Capture of Ad5 Particles with a Purification Matrix

Media was harvested from HEK293 cells grown in suspension, wherein the cells were producing adenovirus type 5 (Ad5) particles carrying a green fluorescent protein (GFP) transgene. The media was contacted with 0 µM, 0.1 µM, 0.5 µM, 1 µM, 10 µM, and 50 µM purification matrix having an amino acid sequence of SEQ ID NO: 173, resulting in the formation of complexes between Ad5 particles and purification matrix. A first environmental factor (i.e. 0.6 M NaCl) was applied to increase the size of the complexes. Subsequently, the media containing the complexes was centrifuged at 13,200 revolutions per minute (rpm) for 10 minutes (min). This protocol allowed for separation of the complexes from impurities on the basis of size.

Figure 12:
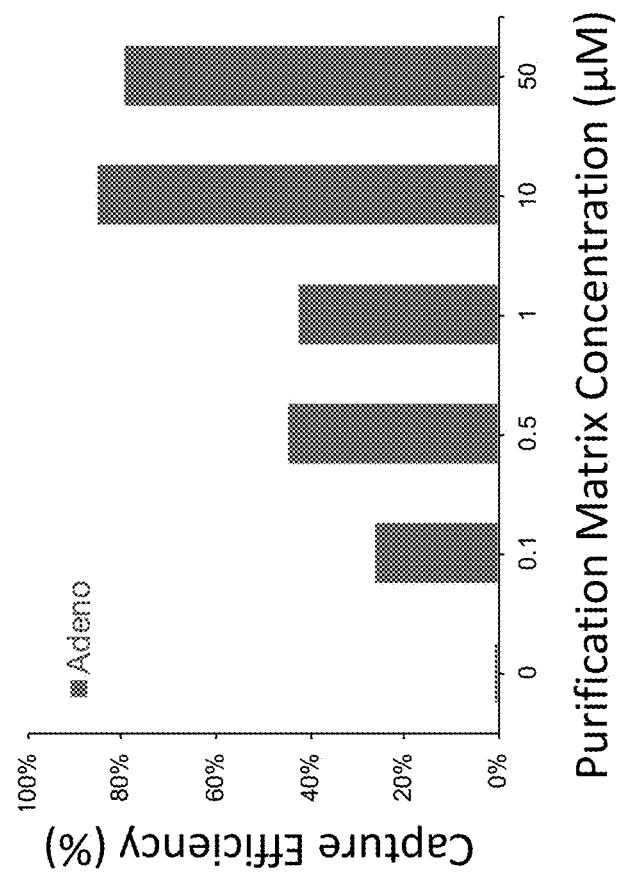
FIG. 12 is a graph showing the effect of purification matrix concentration on the Capture Efficiency of Ad5 particles. The Capture Efficiency was calculated using the following equation: 100×(# of Ad5 particles captured by the purification matrix/# of Ad5 particles in the composition before purification).

Flow cytometry was utilized to evaluate the amount of Ad5 particles captured from the media using the purification matrix compared to the amount of Ad5 particles in the starting material. The Capture Efficiency of the purification matrix at each concentration was calculated using the following equation: 100×(# of Ad5 particles captured by the purification matrix/# of Ad5 particles in the composition before purification). FIG. 12 shows that purification matrix concentrations at or above 10 µM are sufficient for robust, >98%, virus capture.

Example 11. Capture of Lentivirus Particles with a Purification Matrix

Lentivirus particles carrying a green fluorescent protein (GFP) transgene were mixed with 10 µM of purification matrix or PBS (negative control). Mixture of lentivirus particles with purification matrix having an amino acid sequence of SEQ ID NO: 174 leads to the formation of complexes between lentivirus particles and purification matrix. A first environmental factor (i.e. 0.5 M NaCl) was applied to increase the size of the complexes. The composition containing lentivirus particles and purification matrices, and the composition containing lentivirus particles and PBS were centrifuged at 13,200 revolutions per minute (rpm) for 10 minutes (min). The supernatants of each composition, which contained uncaptured lentivirus particles, were added to the media of adherent HEK293 cells for 48 hours. Subsequently, the cells were fluorescently imaged. HEK293 cells incubated with supernatant from the composition comprising lentivirus particles and PBS exhibited greater fluorescence than HEK293 cells incubated with supernatant from the composition comprising lentivirus particles and purification matrix.

Figure 13:
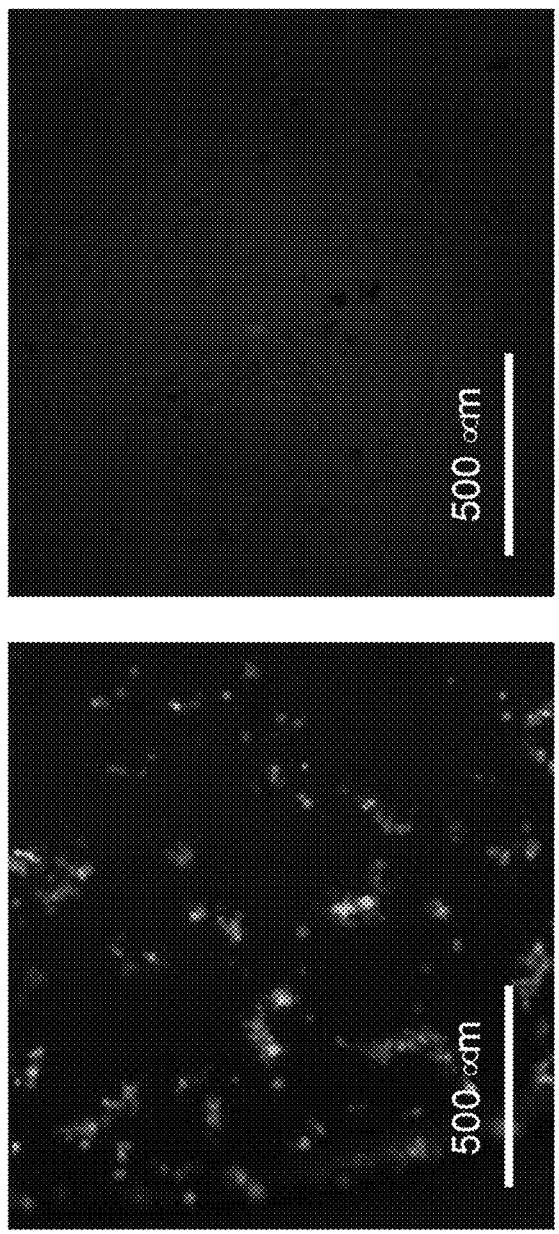
FIG. 13 shows fluorescent images of HEK293 cells incubated with the supernatant of a composition comprising lentivirus particles and phosphate-buffered saline (PBS), labeled LV-GFP control (left) or HEK293 cells incubated with the supernatant of a composition comprising lentivirus particles and purification matrix, labeled LV-GFP with Purification Matrix (right).

Thus, more lentivirus particles were contained in the supernatant of the composition containing lentivirus particles and PBS than the composition containing lentivirus particles and purification matrix. This shows that the purification matrix captured lentivirus particles (FIG. 13).

This experiment is repeated with a purification matrix having an amino acid sequence of SEQ ID NO: 175.

Example 12. Capture of Human Serum Albumin (HSA) with a Purification Matrix

Human serum albumin (HSA) was contacted with a purification matrix having an amino acid sequence of SEQ ID NO: 176 for a period of time to allow complex formation. A first environmental factor was applied to the complexes (i.e. about 0.6 M NaCl) to increase the size of the complexes.

The composition comprising the HAS, purification matrix, and 0.5 M NaCl was applied to two filters, a filter with a 0.2 µm pore size and a filter with a 300 kilodalton (kDa) molecular weight cutoff. The filtrate was applied to a sodium dodecyl sulfate polyacrylamide gel electrophoresis (SDS-PAGE) gel, which was subsequently stained with a Coomassie dye.

Figure 14:
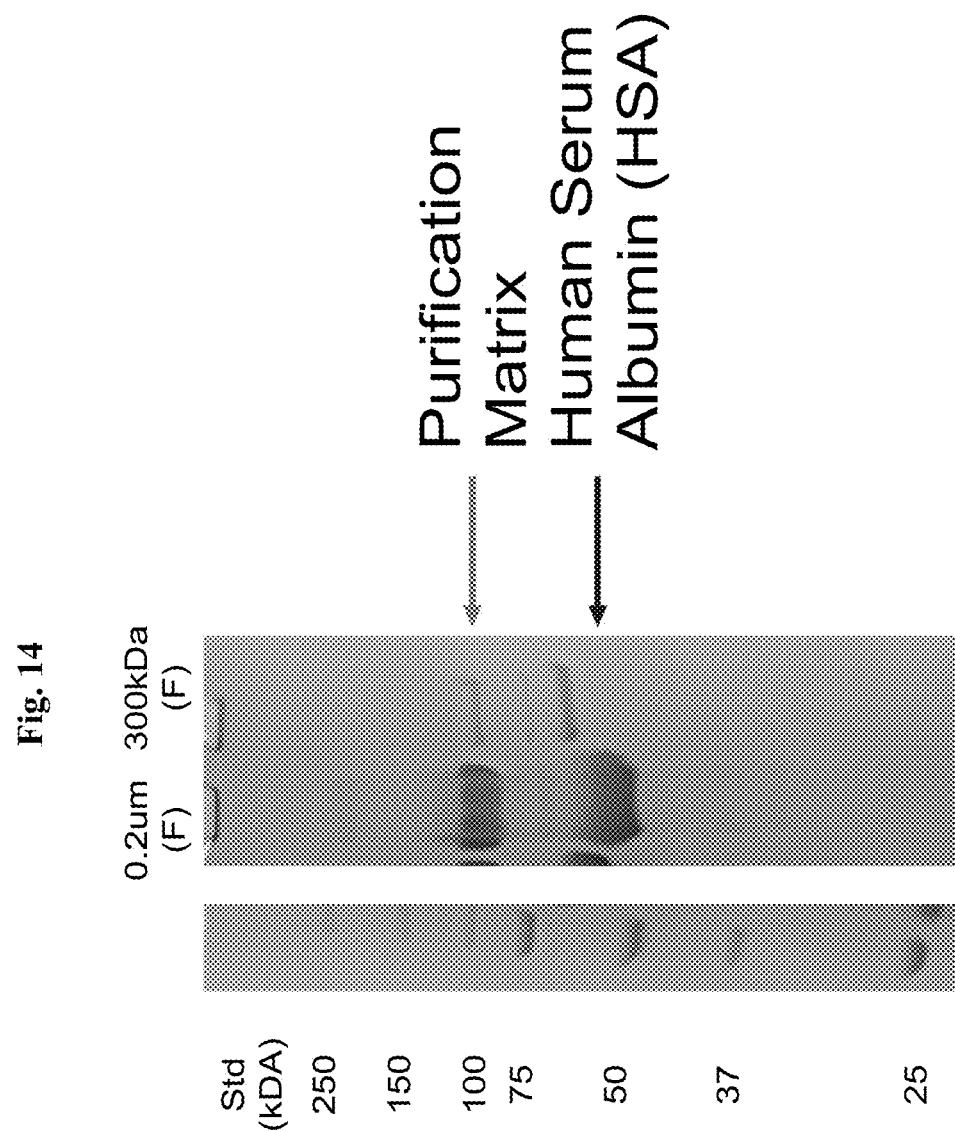
FIG. 14 shows an image of an SDS-PAGE gel. The first lane, labeled "0.2 um (F)", contains the filtrate of a complex between human serum albumin (HSA) and purification matrix after introduction of an environmental factor (0.6 M NaCl) that is applied to a filter with a 0.2 μm pore size. The second lane, labeled "300 kDa (F)", contains the filtrate of a complex between human serum albumin (HSA) and purification matrix after introduction of an environmental factor (0.6 M NaCl) that is applied to a filter with a 300 kDa molecular weight cutoff.

The SDS-PAGE gel shows the presence of a band for HSA (at 66.5 kDa) in the filtrate from the 0.2 µm pore size filter and the absence of the band for HSA in the filtrate from the 300 kDa filter. The 300 kDa filter retained >90% of the HSA. Thus, capturing HSA with a purification matrix, and increasing the size of the complexes with an environmental factor increases the size of HSA such that 90% of the HSA is retained by the filter (FIG. 14).

Example 13. Infectivity of Ad5 Particles in the Presence of Purification Matrix

Media was harvested from HEK293 cells producing adenovirus type 5 (Ad5) particles carrying a green fluorescent protein (GFP) transgene. The media containing Ad5 particles was incubated at room temperature (about 25° C.) or 35° C. with purification matrix having an amino acid sequence of SEQ ID NO: 173, purification matrix control (having no specificity for Ad5), or PBS.

Figure 15:
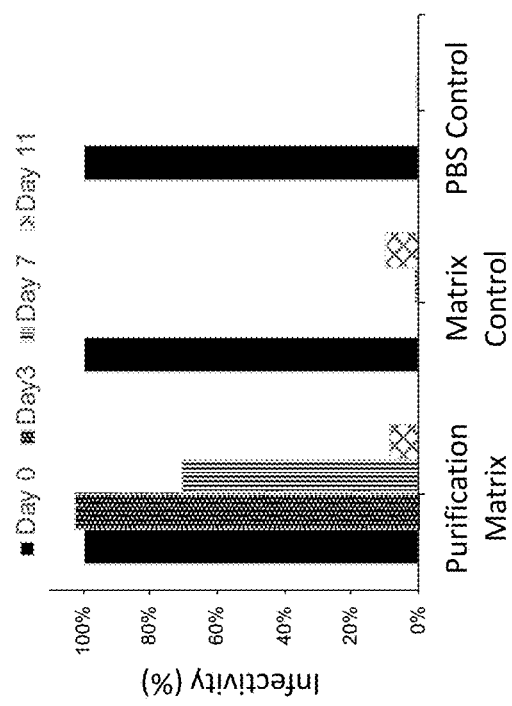
FIG. 15 is a graph showing the ability of Ad5 particles to infect HEK293 cells ("infectivity") 0, 3, 7, 11 days after incubation with purification matrix, matrix control, and PBS (labeled PBS control).
Figure 16:
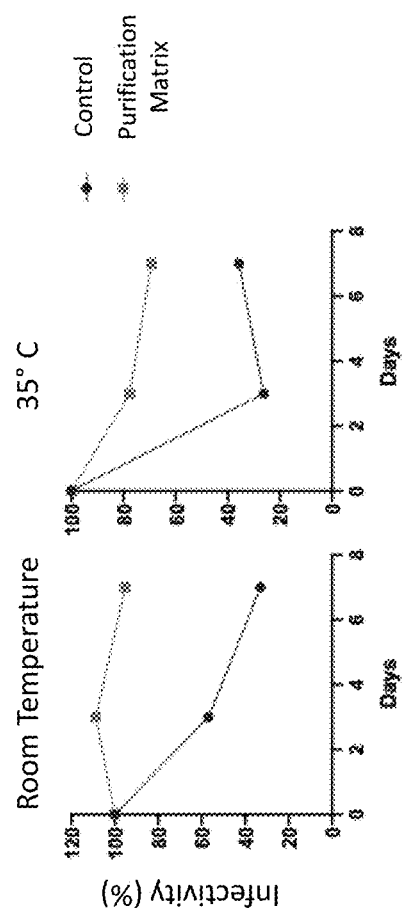
FIG. 16 is a graph showing the ability of Ad5 particles to infect HEK293 cells ("infectivity") incubated with purification matrix or PBS (labeled control) at room temperature (about 25° C.) or 35° C.

At days 0, 3, 7, and 11, post incubation, the media was harvested and administered to HEK293 cells. Flow cytometry was performed to evaluate the ability of the Ad5 particles to infect HEK293 cells, as indicated by the percentage of green fluorescing cells (labeled infectivity in FIG. 15). The infectivity for each source of Ad5 particles was normalized to that source's day 0 infectivity. The infectivity of Ad5 particles obtained from media incubated with purification matrix (labeled Purification Matrix) was higher than the infectivity of Ad5 particles obtained from media incubated with purification matrix control (labeled Matrix Control), and media incubated with PBS (labeled PBS control) after 3, 7, and 11 days (FIG. 15). Media incubated in the presence of purification matrix was more infective than media incubated in the presence of PBS (labeled control) at both room temperature and 35° C. (FIG. 16).

Example 14. Stabilization of Ad5 to Freeze-Thaw Cycles

Figure 17:
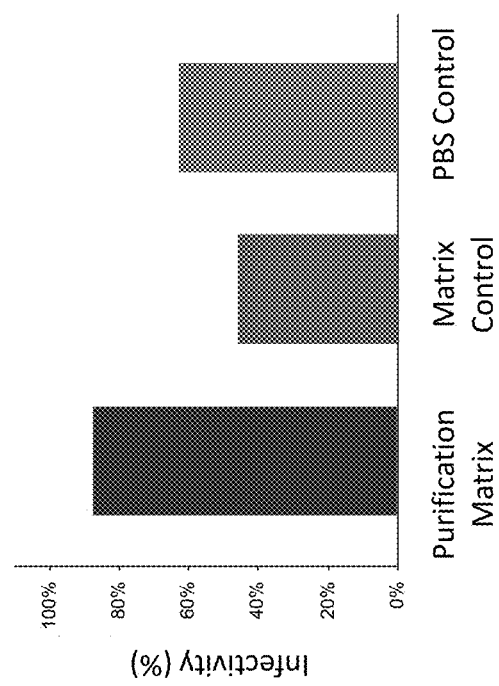
FIG. 17 is a graph showing the ability of Ad5 particles to infect HEK293 cells ("infectivity") incubated with purification matrix, matrix control, or PBS (labeled control) after three freeze-thaw cycles (−80° C. to room temperature).

Purified adenovirus type 5 (Ad5) particles carrying a green fluorescent protein (GFP) transgene were formulated in PBS with or without the addition of 10 µM purification matrix or Matrix control (no specificity for Ad5). The samples were subjected to three freeze-thaw cycles (−80° C. to room temperature). Using flow cytometry, the ability of each composition of Ad5 particles to infect HEK293 cells was quantified by counting the percentage of green fluorescing cells and normalizing the percentage of green fluorescing cells resulting from each composition to a control composition comprising Ad5 particles in the absence of purification matrix that were subjected to freeze-thaw cycles. Ad5 particles incubated with Purification Matrix had 20-40% higher infectivity compared to the Ad5-GFP particles incubated with a Matrix Control or PBS (labeled PBS control). (FIG. 17).

Example 15. Separation of Biologic from Contaminant Using Two Purification Matrices A purification matrix with a lower critical solution temperature transition temperature ($T_t$) is labeled with a blue fluorescent dye and a purification matrix with an upper critical solution temperature (UCST) $T_t$ is labeled with a red fluorescent dye. An environmental factor (e.g. NaCl) is added to the composition comprising both purification matrices to promote the formation of insoluble droplets of both purification matrices. Fluorescence imaging is performed to evaluate if each droplet contains a single purification matrix or both purification matrices.

The ability to form droplets containing a single purification matrix allows for separation of droplets of each purification matrix.

A first purification matrix that binds to a biologic and a second purification matrix that binds to a contaminant is added to a composition containing a biologic and a contaminant. A first complex between the biologic and first purification matrix forms. A second complex between the contaminant and second purification matrix forms. An environmental factor is added to separate the first complex from the second complex.

Example 16. Purification of Recombinant IgG1 Using Purification Matrices and Tangential Flow Filtration (TFF)

Starting material (SM) containing ~4.8 g/L recombinant immunoglobulin 1 (IgG1) secreted from CHO cells was contacted with about 100 μM of purification matrix. The capture domain of the purification matrix binds to the Fc region of IgG1, resulting in a complex between purification matrix and IgG1. An environmental factor (0.6 M NaCl) was added to increase the size of the complexes.

Figure 18:
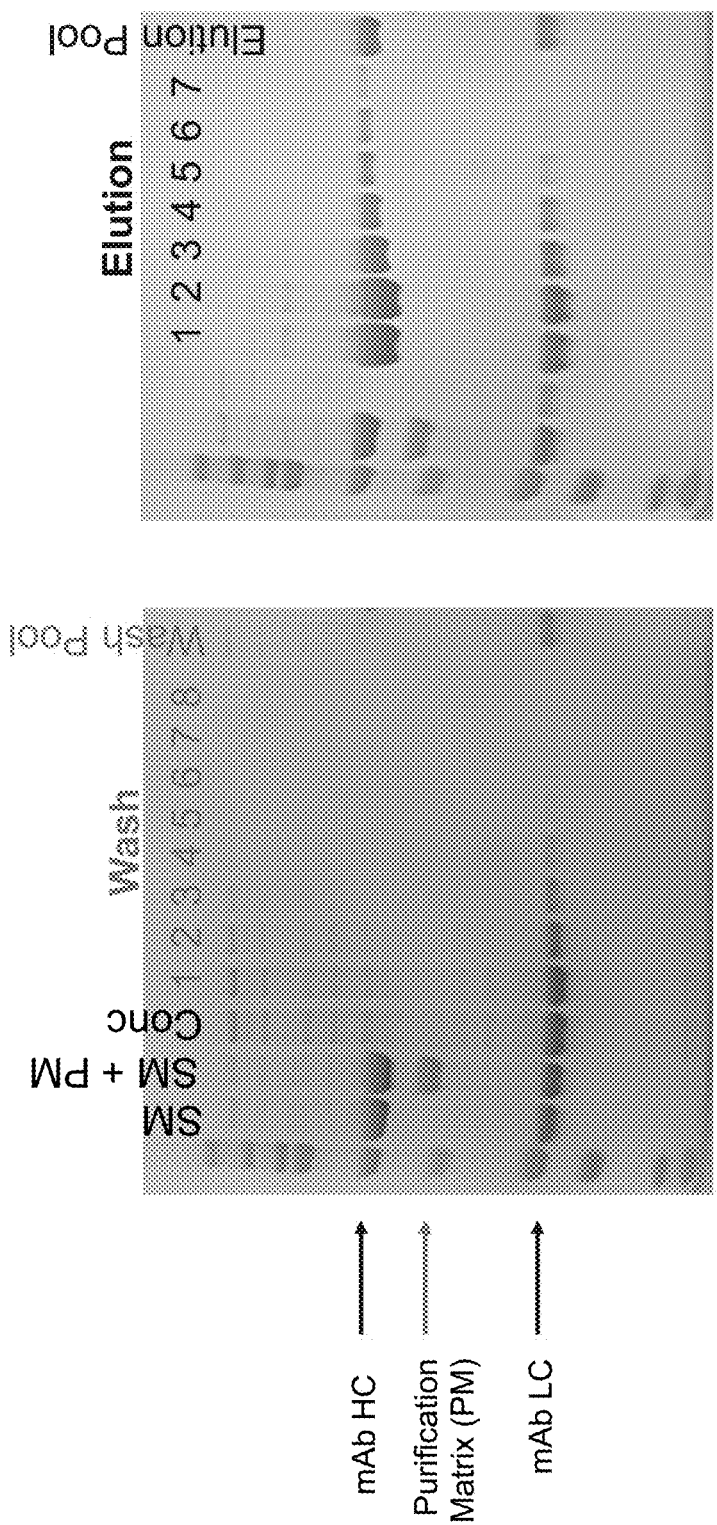
FIG. 18 is an image of SDS-PAGE gels that reveals the presence of IgG1 during tangential flow filtration (TFF) concentration (left), diafiltration (left), and elution (right). The composition containing supernatant of CHO cells expressing IgG1 is referred to as "SM" or starting material. The SM is concentrated via TFF ("Conc") and incubated with purification matrix "SM+PM" to form a complex. During diafiltration, the complexes are washed with 0.6 M NaCl (labeled "1"-"8") to remove impurities. The twelfth lane of the SDS-PAGE gel, labeled "wash pool" is a sample from a pool of the wash fractions. IgG1 is eluted from the complex with an elution buffer containing 50 mM sodium citrate, 0.6 M NaCl at a pH of 3. The SDS-PAGE gel on the right shows elution fractions, labeled "1" to "7" and a pool of the elution fractions labeled "elution pool."

TFF was used to concentrate the complexes and to separate the complexes from impurities. The composition comprising the complexes was applied to a 13 cm² polyethersulfone (PES) membrane which contained 0.2 μm pores. The composition was concentrated 2× and washed with a phosphate-buffered saline (PBS) wash buffer containing 0.6 M NaCl to remove impurities from the complexes. An elution buffer (7 diavolumes) was applied to the filter (50 mM sodium citrate, pH 3, 0.6M NaCl) to separate the IgG from the purification matrix. trigger release of the captured, concentrated and purified IgG1. The purity of the IgG was assessed by an SDS-PAGE gel, stained with a Coomassie dye (FIG. 18). The SDS-PAGE gel shows the high purity and recovery of the eluted IgG1.

Figure 19:
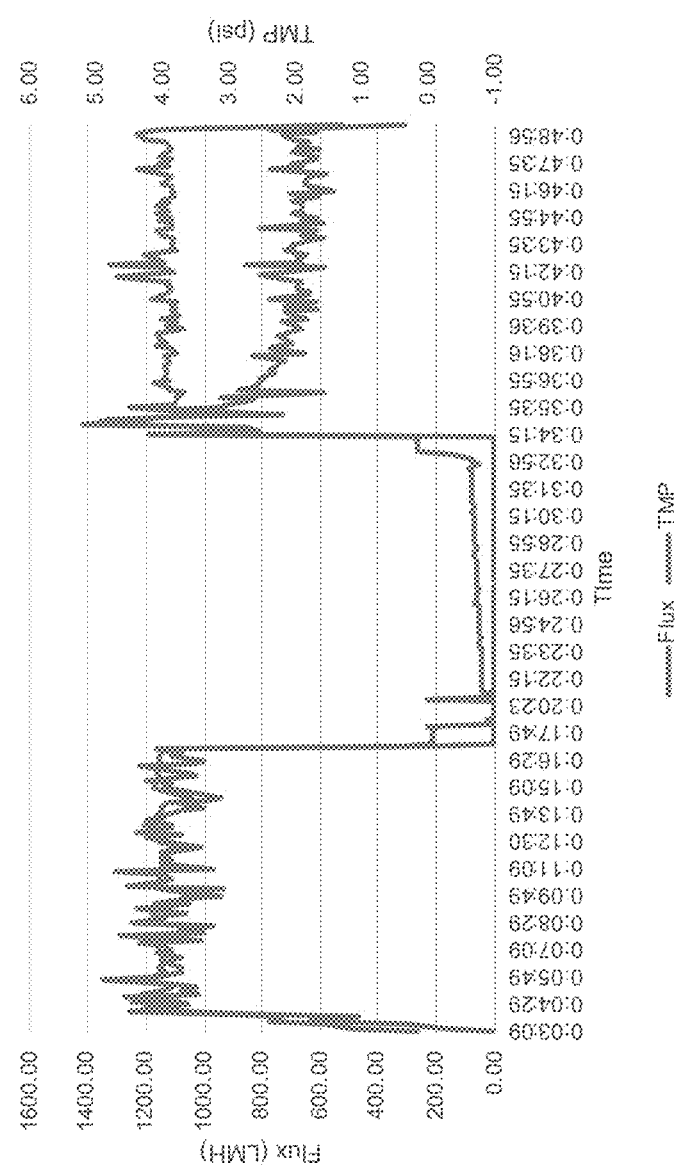
FIG. 19 shows the flux and transmembrane pressure (TMP) throughout tangential flow filtration (TFF) of a solution containing purification matrix and IgG1.

High flux and transmembrane pressure (TMP) were maintained throughout the run (FIG. 19), indicating that the use of TFF enables a reduction in the time required to concentrate and separate a biologic from an impurity.

Figure 20:
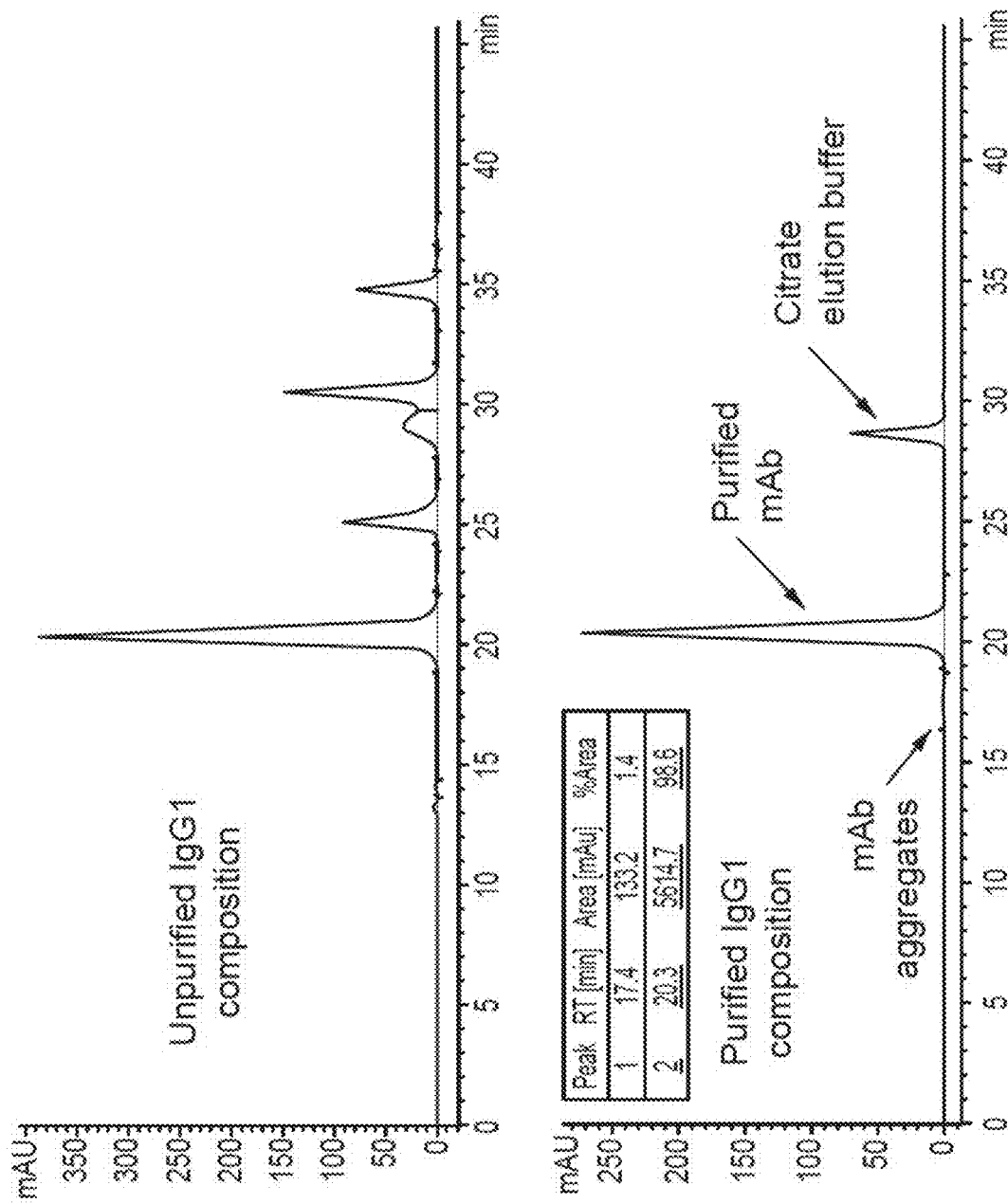
FIG. 20 shows a size exclusion chromatograph of a composition containing impure IgG1 (top) and of the pure IgG1 composition after purification via a purification matrix and tangential flow filtration (bottom).

Size exclusion chromatography was performed to evaluate the purity of the eluted IgG1 product. The IgG1 product was applied to a TSKgel 3000sWXL column, and a mobile phase (i.e. 50 mM phosphate, 100 mM NaCl, at pH 7) was applied to the column at a 0.4 mL/min flow rate. The pure IgG1 was detected by measuring the absorbance at 230 nm. In comparison to the unpurified IgG1 composition, the pure IgG1 was >98% pure. Furthermore, the IgG1 product contained <1.5% of aggregated IgG1 (FIG. 20).

Figure 21:
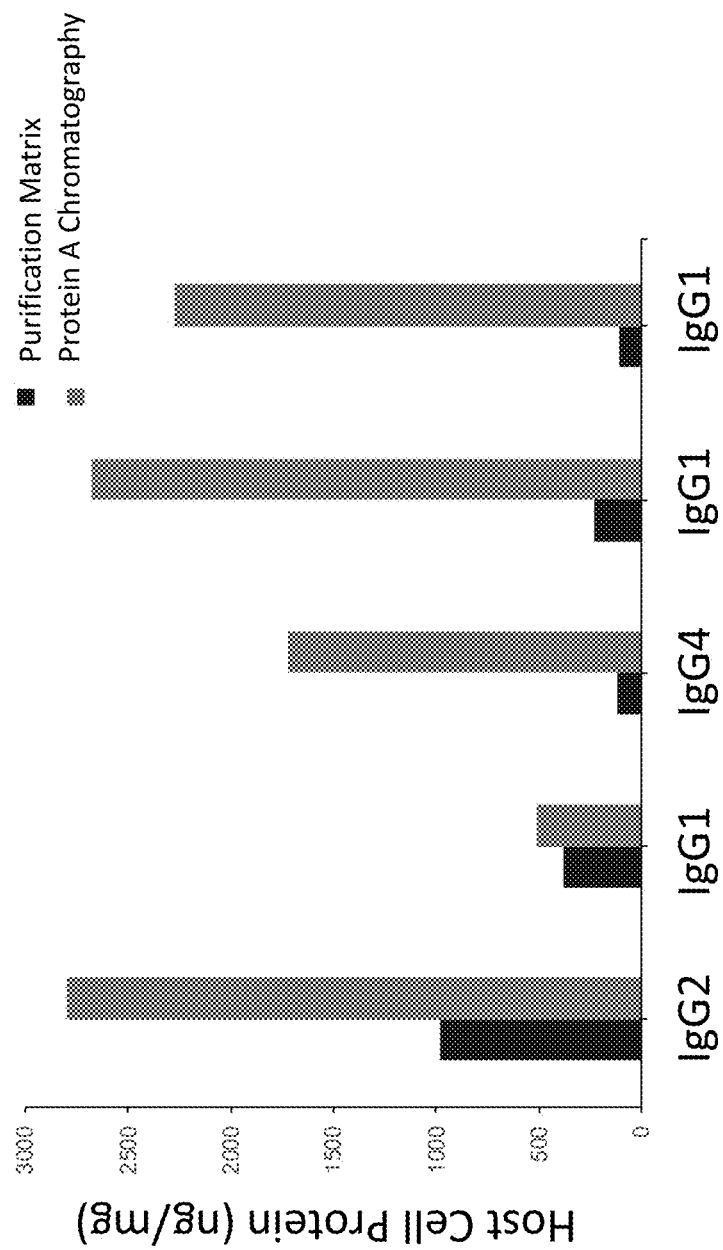
FIG. 21 shows host cell protein impurities in five different immunoglobulin compositions containing IgG2, IgG1, or IgG4 after purification using a purification matrix of the disclosure and tangential flow filtration as opposed to purification via protein A chromatography. Host cell protein impurities were quantitated by ELISA.

The purification process described above was repeated with antibodies of different subclasses (IgG2, IgG4, IgG1). The purity of antibodies purified from the aforementioned method was compared to antibodies purified by protein A chromatography (FIG. 21). Antibodies purified with a purification matrix exhibited less contaminant host cell proteins (HCP) than antibodies purified by protein A chromatography. Host cell proteins were quantified with a Cygnus™ CHO host cell protein (HCP) ELISA detection kit.

Figure 22:
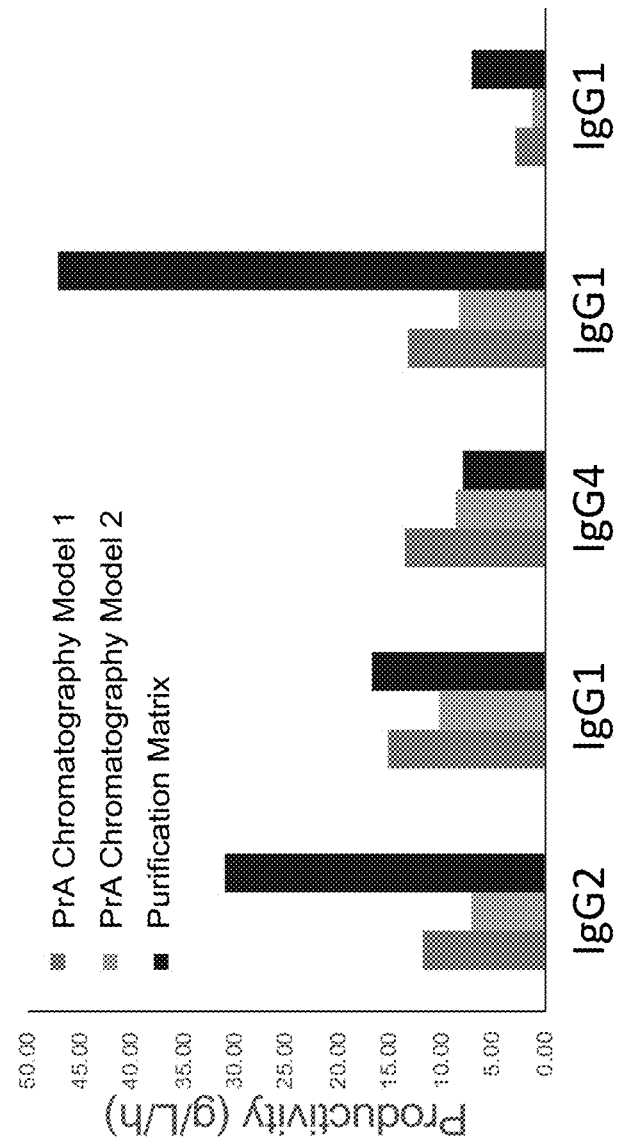
FIG. 22 shows the productivity of a purification matrix for purifying immunoglobulins as described herein, versus two different protein A resins (Mab Select SuRe™ LX and Amsphere™ A3) (labeled "PrA Chromatography Model 1" and "PrA Chromatography Model 2"). The productivity is calculated according to the following equation: amount of antibody purified (grams)/unit of material (Liters)/time (hours). The material refers to the volume of protein A resin or a purification matrix of the disclosure.

The purification matrices also provided higher productivity than the protein A resins used in protein A affinity chromatography (FIG. 22). Productivity was calculated as grams of antibody per unit of material (resin or purification matrix) per hour.

Example 17. Purification of IgG1, IgG2, and IgG4 Using a Purification Matrix The effect of purification matrix on yield and purity of IgG1, IgG2, and IgG4 was evaluated. The following purification methods (a) and (b) were evaluated:

Purification method (a): IgG1, IgG2, or IgG4 from the supernatants of CHO cells containing secreted IgG1, IgG2, or IgG4 was purified by incubating the supernatant with the purification matrix of Example 16 to form complexes, increasing the size of the complexes by the addition of a first environmental factor (i.e., 0.6 M NaCl), separating the complexes from impurities using centrifugation, and eluting the IgG1, IgG2, or IgG4 from the purification matrix with a second environmental factor (i.e., 50 mM sodium citrate, pH 4).

Purification method (b): IgG1, IgG2, or IgG4 from the supernatants of CHO cells containing secreted IgG1, IgG2, or IgG4 was purified by incubating the supernatant with MAbSelect™ SuRe affinity chromatography resin (an alkali-stabilized protein A-derived ligand), washing with 140 mM NaCl, 10 mM phosphate buffer, and 3 mM KCl, pH 7.4, and eluting with 50 mM citrate buffer at pH 3.

Ultraviolet-visible spectrophotometry (UV-Vis) and size exclusion chromatography (SEC) were utilized to determine the yield of IgG1, IgG2, and IgG4 produced according to purification method (a) or purification method (b). Size exclusion chromatography was used to determine the amount of high molecular weight (HMW) and low molecular weight (LMW) impurities in each sample. Purification method (a) resulted in purified immunoglobulin that is more concentrated than that produced by purification method (b). Table 3 shows the yield and percentage of HMW and LMW impurities present in the purified immunoglobulin compositions of purification method (a) and purification (b). The size exclusion chromatography area under the curve (SEC AUC) concentration and yield were obtained by normalizing the area under the curve (AUC) from SEC obtained from method (a) to that of method (2). Molecule-optimized downstream process values are shown in parentheses.

TABLE 3

Yield and concentration of Immunoglobulins by method (a) versus method (b)

| | Cell culture harvest (CCH) titer (g/L) | Concentration (g/L) as determined by UV-Vis | Plate Yield as determined by UV-Vis (%) | SEC AUC Concentration (Normalized) | SEC AUC Yield (Normalized) | SEC Chromatogram AUC Analysis | | |
|---|---|---|---|---|---|---|---|---|
| | | | | | | Peak Containing HMW (%) | Peak containing antibody (%) | Peak Containing LMW (%) |
| IgG 2 | | | | | | (2.8) | (99.6) | (0.0) |
| Method (b) | 3.17 | 1.20 | 22.7 | 1.00 | 1.00 | 1.79 | 97.99 | 0.22 |
| Method (a) | | 4.71 | 74.0 | 3.65 | 3.23 | 3.17 | 96.57 | 0.14 |
| IgG 1 | | | | | | (2.7) | (97.3) | (0.0) |
| Method (b) | 0.87 | 0.39 | 26.9 | 1.00 | 1.00 | 1.55 | 98.45 | 0.00 |
| Method (a) | | 1.32 | 75.6 | 3.50 | 2.30 | 2.54 | 97.25 | 0.21 |
| IgG 4 | | | | | | (0.8) | (99.2) | (0.0) |
| Method (b) | 0.70 | 0.39 | 33.4 | 1.00 | 1.00 | 0.47 | 99.53 | 0.00 |
| Method (a) | | 1.39 | 98.9 | 2.33 | 3.63 | 1.07 | 98.82 | 0.11 |

Example 18. Purification of Multiple AAV Serotypes Using a Purification Matrix Recombinant AAV particles, including AAV1, AAV2, AAV6, AAV8, and AAV9 particles, packaging a tdTomato transgene, were produced in a producer cell line (e.g., HEK293) according to standard protocols. The cells were lysed, and centrifuged to remove cellular debris. The cellular supernatant was contacted with a purification matrix having an amino acid sequence of SEQ ID NO: 172 for a period of time to allow complex formation. An environmental factor (e.g. 0.5 M-2M NaCl, $MgCl_2$, or $CaCl_2$)) was then applied to increase the size of the complexes. The purification matrix, environmental factor, and cellular supernatant were incubated at room temperature for 15 minutes. Subsequently, the purification matrix, environmental factor, and cellular supernatant were concentrated (5-50 fold) using a 13 $cm^2$ hollow filter (0.2 μm pore size). Six wash diavolumes were performed using phosphate buffer solution and sodium chloride. This protocol allowed for separation of the purification matrix, with AAVs bound from impurities on the basis of size. The AAVs were eluted from the purification matrix by applying a buffer (e.g., the second environmental factor). The purification matrix was collected from the retentate. Various buffers were evaluated as shown in Table 5. The AAVs are then titered and frozen at −80° C. for future use.

TABLE 5

Buffers employed as the "second environmental factor"

| Environmental Factor | Composition of Second Environmental Factor |
|---|---|
| A | 0.5 M Arginine (pH = 2); 0.6 M NaCl |
| B | 0.1 M Glycine (pH = 2); 0.6 M NaCl |
| C | 0.1 M Glycine (pH = 2); 0.6 M $MgCl_2$ |
| D | 0.1 M Glycine (pH = 2); 0.6 M $CaCl_2$ |

Figure 23:
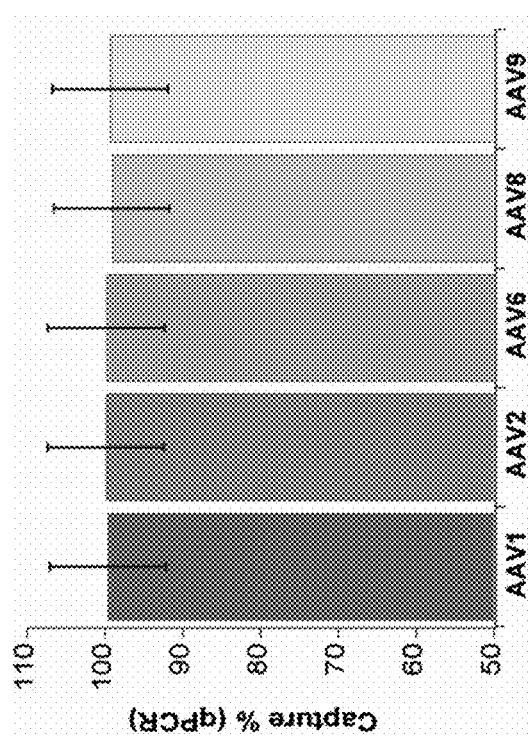
FIG. 23 shows the percentage of AAV particles captured from cellular supernatant using a purification matrix, as determined by quantitative polymerase chain reaction (qPCR).
Figure 24:
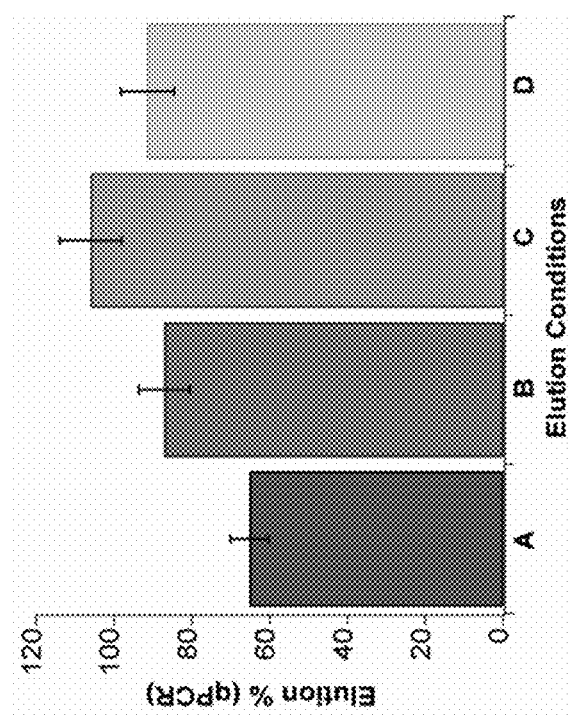
FIG. 24 shows the percentage of AAV particles eluted from the purification matrix, as determined by qPCR, using various elution conditions (e.g., second environmental factors).

Quantitative real-time polymerase chain reaction (qPCR) was utilized to evaluate the amount of AAV captured from solution and the amount of AAV obtained after elution. The purification matrix captured greater than 99% of AAV particles of multiple serotypes (AAV1, AAV2, AAV6, AAV8, and AAV9) (FIG. 23). Each buffer evaluated eluted over 65% of bound AAV particles in a single diavolume (FIG. 24).

The purification matrix was recycled after elution of the AAV particles to determine whether or not it could be utilized for future purifications. Recycling was performed by incubating the purification matrix at 95° C. for 5 minutes or soaking the purification matrix in 1 M NaOH or 6 M guanidine hydrochloride for five minutes.

As Table 6 shows, the purification matrix can be regenerated and utilized for repeated capture. After five cycles of purification/regeneration, the purification matrix captures 98% of AAV.

TABLE 6

Recycling of Purification Matrix

| # of times purification matrix has been used | Captured viral genome (vg)/milliliter (mL) | % Capture |
|---|---|---|
| 1 | $8.46 \times 10^{10}$ | 97 |
| 2 | $8.60 \times 10^{10}$ | 98 |
| 3 | $8.61 \times 10^{10}$ | 99 |
| 4 | $8.57 \times 10^{10}$ | 98 |
| 5 | $8.53 \times 10^{10}$ | 98 |

Figure 25:
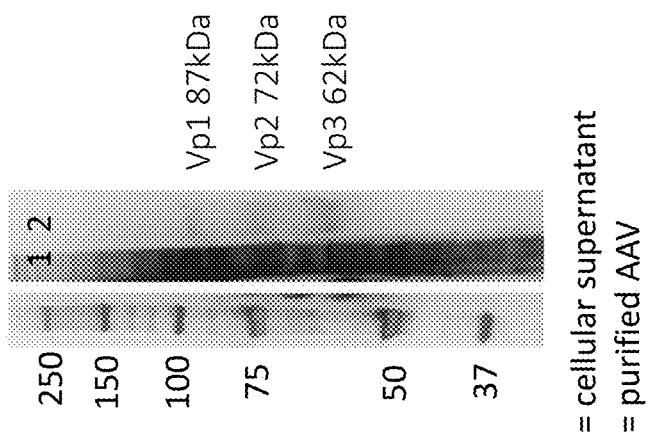
FIG. 25 provides an image of a silver-stained gel containing samples of (1) unpurified cellular supernatant, and (2) a sample comprising AAV particles purified according to the methods of the disclosure. In the sample containing AAV particles, bands for VP1, VP2, and VP3 proteins were observed at the expected sizes (i.e., 87 kDa, 72 kDa, and 62 kDa, respectively).
Figure 26:
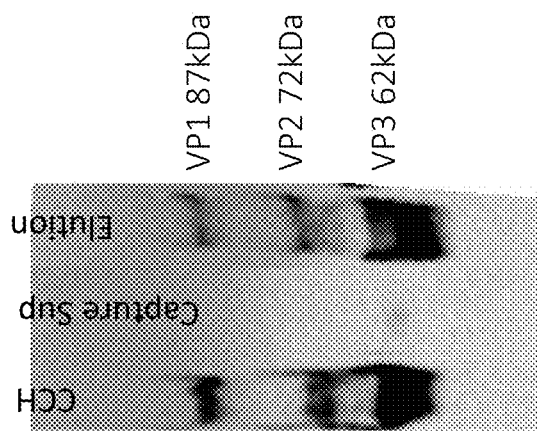
FIG. 26 provides an image of a Western Blot, showing that AAV VP1, VP2, and VP3 capsid proteins present in cellular supernatant were successfully captured and removed from the cellular supernatant using a purification matrix described herein.

Sodium dodecycl sulfate-polyacrylamide gel electrophoresis (SDS-PAGE) was utilized to evaluate the purity of the eluted AAV samples. The gels were then silver stained, to visualize any contaminants in the sample. As shown in FIG. 25, the major AAV structural proteins Vp1, Vp2, and Vp3 were visible on the gel, but no other major bands were observed. A Western Blot confirmed the presence of capsid proteins in the sample that had been eluted from the purification matrix (FIG. 26). Furthermore, after the AAV particles were captured by the purification matrix, no AAV particles remained in the capture supernatant (Capture Sup of FIG. 26). Taken together, this data indicates that, after elution from the purification matrix, substantially all contaminants have been removed from the sample, and the isolated AAV has a high degree of purity.

In a subsequent experiment, it was evaluated whether the purification matrix is able to capture full capsids, empty capsids, or both. Total number of AAV capsids present in samples eluted from the purification matrix was estimated using an ELISA-based assay. The eluted samples were also evaluated using qPCR, to determine the number of viral genomes. A qPCR:ELISA value was used to approximate the ratio of full capsids relative to total capsids. As shown in Table 7, the purification matrix enriched for full capsids.

TABLE 7

Enrichment for Full AAV Capsid

| Method | Starting Quantity | Capture % | Elution Quantity | Change in Full % |
|---|---|---|---|---|
| qPCR | $5.78 \times 10^{10}$ | 99.2 | $5.73 \times 10^{10}$ | 33% → 70% |
| ELISA | $1.76 \times 10^{11}$ | 99.9 | $8.14 \times 10^{10}$ | |

Figure 27A:
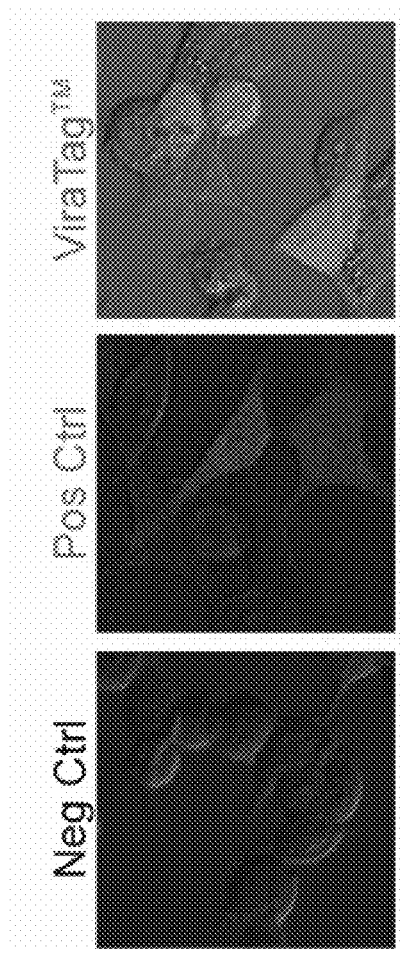
FIG. 27A shows pictures of cells infected with a control AAV particle (Pos Ctrl), or an AAV8 particle carrying a tdTomato transgene that was either (i) not purified by the methods of the disclosure (Pos Ctrl) or (ii) purified with a purification matrix of the disclosure (e.g. ViraTag'). Both control AAV and AAV purified with ViraTag' are infectious. The image labeled "Neg Ctrl" shows cells which were not infected with any AAV particles.
Figure 27B:
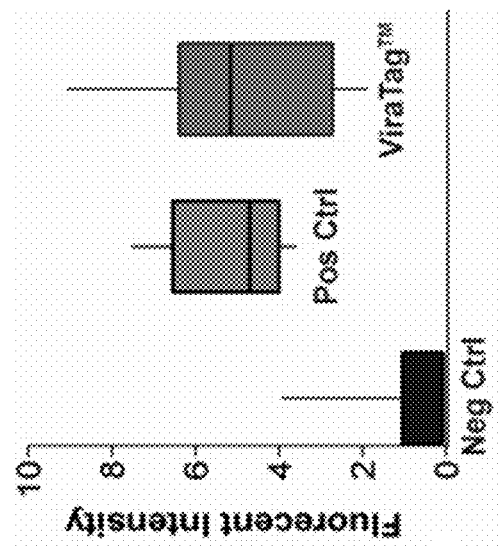
FIG. 27B shows the fluorescence intensity of cells infected with a control AAV particle (Pos Ctrl) or an AAV particle purified using a purification matrix as described herein (e.g. ViraTag'). Both types of AAV particles tested carried a tdTomato transgene.

The eluted AAV samples were also assayed to determine whether they maintained infectivity after purification. AAV8 carrying a tdTomato transgene was administered to HEK293 cells (10,000 cells/well) in culture at a multiplicity of infection (MOI) $1 \times 10^6$ or $1 \times 10^7$. After 48 of incubation, the cells were visualized for tdTomato fluorescence using fluorescence microscopy. As shown in FIG. 27A, AAV purified by the purification matrix (ViraTag™) infected cells to a similar extent as AAVs purified according to standard protocols (Pos Ctrl). This data was quantified, as shown in FIG. 27B. There was no statistically significant difference between infectivity levels of the AAV8 purified by standard protocols (Pos Ctrl) and the AAV8 purified by the purification matrix (ViraTag™). Accordingly, this data shows that AAV particles purified using the tested purification matrix (ViraTag™) retain high levels of infectivity.

NUMBERED EMBODIMENTS

Notwithstanding the appended claims, the disclosure sets forth the following numbered embodiments:

Method of Purifying a Biologic from a Contaminant

1. A method of purifying a biologic comprising contacting the biologic with a protein-based purification matrix;
wherein the biologic binds to the purification matrix to form a complex;
wherein the size of the complex is increased by a first environmental factor;
wherein the complex is separated from at least one contaminant on the basis of size; and
wherein the biologic is separated from the purification matrix by a second environmental factor.

2. The method of embodiment 1, wherein the purification matrix comprises (i) a capture domain which binds to the biologic, and (ii) a polypeptide with phase behavior, wherein the capture domain is coupled to the polypeptide with phase behavior.

3. The method of embodiment 2, wherein the capture domain is coupled to the polypeptide with phase behavior via a linker.

4. The method of embodiment 3, wherein the linker is a peptide linker.

5. The method of embodiment 4, wherein the peptide linker comprises a protease cleavage site.

6. The method of embodiment 3, wherein the linker is a chemical linker.

7. The method of embodiment 1, wherein the purification matrix comprises a fusion protein comprising (i) a capture domain which binds to the biologic and (ii) a polypeptide with phase behavior.

8. The method of any one of embodiments 2-7, wherein the polypeptide with phase behavior is a resilin-like polypeptide.

9. The method of any one of embodiments 2-7, wherein the polypeptide with phase behavior is an elastin-like polypeptide.

10. The method of any one of 2-7 or 9, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

11. The method of embodiment 10, wherein n is an integer from 1 to 360, inclusive of endpoints.

12. The method of any one of embodiments 2-7 or 9, wherein the polypeptide with phase behavior comprises an amino acid sequence selected from:

a.
(GRGDSPY)$_n$ (SEQ ID NO: 1)

b.
(GRGDSPH)$_n$ (SEQ ID NO: 2)

c.
(GRGDSPV)$_n$ (SEQ ID NO: 3)

d.
(GRGDSPYG)$_n$ (SEQ ID NO: 4)

e.
(RPLGYDS)$_n$ (SEQ ID NO: 5)

f.
(RPAGYDS)$_n$ (SEQ ID NO: 6)

g.
(GRGDSYP)$_n$ (SEQ ID NO: 7)

h.
(GRGDSPYQ)$_n$ (SEQ ID NO: 8)

i.
(GRGNSPYG)$_n$ (SEQ ID NO: 9)

j.
(GVGVP)$_n$; (SEQ ID NO: 11)

k.
(GVGVPGLGVPGVGVPGLGVPGVGVP)$_m$; (SEQ ID NO: 12)

l.
(GVGVPGVGVPGAGVPGVGVPGVGVP)$_m$; (SEQ ID NO: 13)

m.
(GVGVPGWGVPGVGVPGWGVPGVGVP)$_m$; (SEQ ID NO: 14)

n.
(GVGVPGVGVPGVGVPGVGVPGVGVPGEGVPGFGVPGVGVP)$_m$; (SEQ ID NO: 15)

o.
(GVGVPGVGVPGVGVPGVGVPGVGVPGKGVPGFGVPGVGVP)$_m$; (SEQ ID NO: 16)

and p.
(GAGVPGVGVPGAGVPGVGVPGAGVP)$_m$; (SEQ ID NO: 17)

or a randomized, scrambled analog thereof;
wherein:
n is an integer in the range of 20-360, inclusive of endpoints; and m is an integer in the range of 4-25, inclusive of endpoints.

13. The method of any one of embodiments 2-7 or 9, wherein the polypeptide with phase behavior comprises an amino acid sequence selected from:

(a)
(GVGVP)$_m$; (SEQ ID NO: 52)

(b)
(ZZPXXXXGZ)$_m$; (SEQ ID NO: 57)

(c)
(ZZPXGZ)$_m$; (SEQ ID NO: 58)

(d)
(ZZPXXGZ)$_m$; or (SEQ ID NO: 59)

(e)
(ZZPXXXGZ)$_m$, (SEQ ID NO: 60)

wherein m is an integer between 10 and 160, inclusive of endpoints, wherein X if present is any amino acid except proline or glycine, and wherein Z if present is any amino acid.

14. The method of any one of embodiments 2-7 or 9, wherein the polypeptide with phase behavior comprises an amino acid sequence selected from:

(a)
(GVGVPGVGVPGAGVPGVGVPGVGVP)$_m$; or (SEQ ID NO: 53)

(b)
(GVGVPGVGVPGLGVPGVGVPGVGVP)$_m$; (SEQ ID NO: 55)

wherein m is an integer between 2 and 32, inclusive of endpoints.

15. The method of any one of embodiments 2-7 or 9, wherein the polypeptide with phase behavior comprises an amino acid sequence selected from:
  (a) (GVGVPGVGVPGAGVPGVGVPGVGVP)$_m$ (SEQ ID NO: 193), wherein m is 8 or 16;
  (b) (GVGVPGAGVP)$_m$ (SEQ ID NO: 54), wherein m is an integer between 5 and 80, inclusive of endpoints; or
  (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16. The method of any one of embodiments 2-15, wherein the capture domain comprises the sequence of any one of SEQ ID NO: 24-49, 62-148, 167-171 or a sequence having at least 1, at least 2, at least 3, at least 4, or at least 5 mutations relative thereto.

17. The method of any one of embodiments 2-15, wherein the binding of the biologic to the purification matrix is reversible.

18. The method of any one of embodiments 2-15, wherein the binding of the biologic to the purification matrix is non-covalent.

19. The method of any one of embodiments 2-15, wherein the binding of the biologic to the purification matrix is covalent.

20. The method of any one of embodiments 1-19, wherein the biologic is a lipid, a lipopolysaccharide, a cell, a protein, a nucleic acid, a carbohydrate, or a viral particle.

21. The method of embodiment 20, wherein the biologic is a cell.

22. The method of embodiment 21, wherein the cell is a bacterial cell, a yeast cell, or a mammalian cell.

23. The method of embodiment 21 or 22, wherein the cell is a stem cell, a bone cell, a blood cell, a muscle cell, a fat cell, a skin cell, a nerve cell, an endothelial cell, a sex cell, a pancreatic cell, or a cancer cell.

24. The method of embodiment 21 or 22, wherein the cell is an immune cell.

25. The method of embodiment 24, wherein the immune cell is a T cell, a B cell, a NK cell, a peripheral blood mononuclear cell, or a neutrophil.

26. The method of embodiment 25, wherein the cell is a T cell expressing a chimeric antigen receptor (CAR).

27. The method of embodiment 20, wherein the nucleic acid is a DNA or an RNA.

28. The method of embodiment 17, wherein the viral particle is an adenovirus particle, an adeno-associated virus (AAV) particle, a lentivirus particle, a retrovirus particle, a poxvirus particle, a measles virus particle, or a herpesvirus particle.

29. The method of any one of embodiments 1-28, wherein the biologic has a diameter between 1 nm and 100 µm, inclusive of the endpoints.

30. The method of embodiment 29, wherein the biologic has a diameter between 1 nm and 100 nm, inclusive of the endpoints.

31. The method of embodiment 29, wherein the biologic has a diameter between 100 nm and 1 µm, inclusive of the endpoints.

32. The method of embodiment 29, wherein the biologic has a diameter between 1 µm and 50 µm, inclusive of the endpoints.

33. The method of embodiment 29, wherein the biologic has a diameter between 50 µm and 100 µm, inclusive of the endpoints.

34. The method of any one of embodiments 1-33, wherein the method is completed in about 0.5 to about 24 hours.

35. The method of embodiment 34, wherein the method is completed in about 0.5 to about 8 hours.

36. The method of embodiment 34, wherein the method is completed in about 2 to about 6 hours.

37. The method of any one of embodiments 1-36, wherein the separation of the complex from the at least one contaminant can be observed visually with an unaided eye.

38. The method of any one of embodiments 1-37, wherein the increase in the size of the complex is at least a 2-fold increase.

39. The method of embodiment 38, wherein the increase in the size of the complex is at least a 10-fold increase.

40. The method of embodiment 38, wherein the increase in the size of the complex is at least a 25-fold increase.

41. The method of any one of embodiments 38-40, wherein the increase in size is an increase in the mass of the complex.

42. The method of any one of embodiments 38-40, wherein the increase in size is an increase in the diameter of the complex.

43. The method of any one of embodiments 1-42, wherein the first environmental factor comprises one or more of:
  a. a change in one or more of temperature, pH, salt concentration, concentration of the purification matrix, concentration of the biologic, or pressure;

b. the addition of one or more surfactants, cofactor, vitamin, molecular crowding agents, reducing agents, oxidizing agents, enzymes, or denaturing agents; or c. the application of electromagnetic or acoustic waves.

44. The method of any one of embodiments 1-42, wherein the second environmental factor comprises one or more of:

a. a change in one or more of temperature, pH, salt concentration, concentration of the purification matrix, concentration of the biologic, or pressure;

b. the addition of one or more surfactants, molecular crowding agents, reducing agents, enzymes, denaturing agents, cofactor, vitamin, or oxidizing agents; or c. the application of electromagnetic or acoustic waves.

45. The method of any one of embodiments 1-44, wherein the separation on the basis of size is performed using tangential flow filtration, membrane chromatography, analytical ultracentrifugation, high performance liquid chromatography, membrane chromatography, normal flow filtration, acoustic wave separation, centrifugation, counterflow centrifugation, and fast protein liquid chromatography.

46. The method of any one of embodiments 1-45, wherein the at least one contaminant is selected from a solvent, an endotoxin, a protein, a peptide, a nucleic acid, and a carbohydrate.

47. The method of any one of embodiments 1-46, wherein the purification yield of the biologic is at least 70%, at least 80%, at least 90%, at least 95%, at least 96%, at least 97%, at least 98%, or at least 99%.

48. The method of any one of embodiments 1-47, wherein the biologic is purified to at least 70%, at least 80%, at least 90%, at least 95%, at least 96%, at least 97%, at least 98%, or at least 99% purity.

Method of Removing a Contaminant from a Composition Comprising a Biologic

1a. A method of removing a contaminant from a composition comprising a biologic, the method comprising contacting the contaminant with a protein-based purification matrix; wherein the contaminant binds to the matrix to form a complex;

wherein the size of the complex is increased by a first environmental factor;

wherein the complex is separated from the biologic on the basis of size; and wherein the contaminant is separated from the matrix by a second environmental factor.

2a. The method of embodiment 1a, wherein the purification matrix comprises (i) a capture domain which binds to the contaminant, and (ii) a polypeptide with phase behavior, wherein the capture domain is coupled to the polypeptide with phase behavior.

3a. The method of embodiment 2a, wherein the capture domain is coupled to the polypeptide with phase behavior via a linker.

4a. The method of embodiment 3a, wherein the linker is a peptide linker.

5a. The method of embodiment 4a, wherein the peptide linker comprises a protease cleavage site.

6a. The method of embodiment 3a, wherein the linker is a chemical linker.

7a. The method of embodiment 1a, wherein the purification matrix comprises a fusion protein comprising (i) a capture domain which binds to the contaminant and (ii) a polypeptide with phase behavior.

8a. The method of any one of embodiments 2a-7a, wherein the polypeptide with phase behavior is a resilin-like polypeptide.

9a. The method of any one of embodiments 2a-7a, wherein the polypeptide with phase behavior is an elastin-like polypeptide.

10a. The method of any one of 2a-7a or 9a, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

11a. The method of embodiment 10a, wherein n is an integer from 1 to 360, inclusive of endpoints.

12a. The method of any one of embodiments 2a-7a or 9a, wherein the polypeptide with phase behavior comprises an amino acid sequence selected from:

a.
(SEQ ID NO: 52)
(GVGVP)$_m$;

b.
(SEQ ID NO: 57)
(ZZPXXXGZ)$_m$;

c.
(SEQ ID NO: 58)
(ZZPXGZ)$_m$;

d.
(SEQ ID NO: 59)
(ZZPXXGZ)$_m$;
or e.
(SEQ ID NO: 60)
(ZZPXXXGZ)$_m$, or a randomized, scrambled analog thereof;

wherein:

n is an integer in the range of 20-360, inclusive of endpoints; and m is an integer in the range of 4-25, inclusive of endpoints.

13a. The method of any one of embodiments 2a-7a or 9a, wherein the polypeptide with phase behavior comprises an amino acid sequence selected from:

a.
(SEQ ID NO: 52)
(GVGVP)$_m$;

b.
(SEQ ID NO: 57)
(ZZPXXXGZ)$_m$;

c.
(SEQ ID NO: 58)
(ZZPXGZ)$_m$;

d.
(SEQ ID NO: 59)
(ZZPXXGZ)$_m$;
or e.
(SEQ ID NO: 60)
(ZZPXXXGZ)$_m$, wherein m is an integer between 10 and 160, inclusive of endpoints, wherein X if present is any amino acid except proline or glycine, and wherein Z if present is any amino acid.

14a. The method of any one of embodiments 2a-7a or 9a, wherein the polypeptide with phase behavior comprises an amino acid sequence selected from:

(a)

(GVGVPGVGVPGAGVPGVGVPGVGVP)$_m$; or (SEQ ID NO: 53)

(b)

(GVGVPGVGVPGLGVPGVGVPGVGVP)$_m$; (SEQ ID NO: 55)

wherein m is an integer between 2 and 32, inclusive of endpoints.

15a. The method of any one of embodiments 2a-7a or 9a, wherein the polypeptide with phase behavior comprises an amino acid sequence selected from:
 (a) (GVGVPGVGVPGAGVPGVGVPGVGVP)$_m$ (SEQ ID NO: 193), wherein m is 8 or 16;
 (b) (GVGVPGAGVP)$_m$ (SEQ ID NO: 54), wherein m is an integer between 5 and 80, inclusive of endpoints; or
 (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16a. The method of any one of embodiments 2a-15a, wherein the capture domain comprises the sequence of any one of SEQ ID NO: 24-49, 62-148, or 167-171 or a sequence having at least 1, at least 2, at least 3, at least 4, or at least 5 mutations relative thereto.

17a. The method of any one of embodiments 1a-16a, wherein the binding of the contaminant to the purification matrix is reversible.

18a. The method of any one of embodiments 1a-16a, wherein the binding of the contaminant to the purification matrix is non-covalent.

19a. The method of any one of embodiments 1a-16a, wherein the binding of the contaminant to the purification matrix is covalent.

20a. The method of any one of embodiments 1a-19a, wherein the biologic is a lipid, lipopolysaccharide, cell, a protein, a nucleic acid, a carbohydrate, or a viral particle.

21a. The method of embodiment 20a, wherein the biologic is a cell.

22a. The method of embodiment 32a, wherein the cell is a bacterial cell, a yeast cell, or a mammalian cell.

23a. The method of embodiment 21a or 22a, wherein the cell is a stem cell, a bone cell, a blood cell, a muscle cell, a fat cell, a skin cell, a nerve cell, an endothelial cell, a sex cell, a pancreatic cell, or a cancer cell.

24a. The method of embodiments 21a or 22a, wherein the cell is an immune cell.

25a. The method of embodiment 24a, wherein the immune cell is a T cell, a B cell, a NK cell, a peripheral blood mononuclear cell, or a neutrophil.

26a. The method of embodiment 25a, wherein the cell is a T cell expressing a chimeric antigen receptor (CAR).

27a. The method of embodiment 20a, wherein the nucleic acid is a DNA or an RNA.

28a. The method of embodiment 20a, wherein the viral particle is an adenovirus particle, an adeno-associated virus (AAV) particle, a lentivirus particle, a retrovirus particle, a poxvirus particle, a measles virus particle, or a herpesvirus particle.

29a. The method of any one of embodiments 1a-28a, wherein the biologic has a diameter between 1 nm and 100 µm, inclusive of the endpoints.

30a. The method of embodiment 29a, wherein the biologic has a diameter between 1 nm and 100 nm, inclusive of the endpoints.

31a. The method of embodiment 29a, wherein the biologic has a diameter between 100 nm and 1 µm, inclusive of the endpoints.

32a. The method of embodiment 29a, wherein the biologic has a diameter between 1 µm and 50 µm, inclusive of the endpoints.

33a. The method of embodiment 29a, wherein the biologic has a diameter between 50 µm and 100 µm, inclusive of the endpoints.

34a. The method of any one of embodiments 1a-33a, wherein the method is completed in about 0.5 to about 24 hours.

35a. The method of embodiment 34a, wherein the method is completed in about 0.5 to about 8 hours.

36a. The method of embodiment 34a, wherein the method is completed in about 2 to about 6 hours.

37a. The method of any one of embodiments 1a-36a, wherein the separation of the complex from the composition comprising a biologic can be observed visually with an unaided eye.

38a. The method of any one of embodiments 1a-37a, wherein the increase in the size of the complex is at least a 2-fold increase.

39a. The method of embodiment 80a, wherein the increase in the size of the complex is at least a 10-fold increase.

40a. The method of embodiment 39a, wherein the increase in the size of the complex is at least a 25-fold increase.

41a. The method of any one of embodiments 38a-40a, wherein the increase in size is an increase in the mass of the complex.

42a. The method of any one of embodiments 38a-40a, wherein the increase in size is an increase in the diameter of the complex.

43a. The method of any one of embodiments 1a-42a, wherein the first environmental factor comprises one or more of:
 a. a change in one or more of temperature, pH, salt concentration, concentration of the purification matrix, concentration of the biologic, or pressure;
 b. the addition of one or more surfactants, molecular crowding agents, reducing agents, oxidizing agents, enzymes, cofactor, vitamin, or denaturing agents; or
 c. the application of electromagnetic or acoustic waves.

44a. The method of any one of embodiments 1a-42a, wherein the second environmental factor comprises one or more of:
 a. a change in one or more of temperature, pH, salt concentration, concentration of the purification matrix, concentration of the biologic, or pressure;
 b. the addition of one or more surfactants, molecular crowding agents, reducing agents, oxidizing agents, enzymes, cofactor, vitamin, or denaturing agents; or
 c. the application of electromagnetic or acoustic waves.

45a. The method of any one of embodiments 1a-44a, wherein the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

46a. The method of any one of embodiments 1a-45a, wherein the contaminant is selected from a solvent, an endotoxin, a protein, a peptide, a nucleic acid, and a carbohydrate.

47a. The method of any one of embodiments 1a-46a, wherein at least 70%, at least 80%, at least 90%, at least 95%, at least 96%, at least 97%, at least 98%, or at least 99% of the contaminant is removed.

Method of Purifying a Biologic from a Contaminant

1b. A method of purifying a biologic, the method comprising contacting the biologic with a protein-based purification matrix;
wherein the biologic binds to the matrix to form a complex;
wherein the size of the complex is increased;
wherein the complex is separated from at least one contaminant on the basis of size; and
wherein the biologic is separated from the matrix by an environmental factor.

2b. The method of embodiment 1b, wherein the purification matrix comprises (i) a capture domain which binds to the biologic, and (ii) a polypeptide with phase behavior, wherein the capture domain is coupled to the polypeptide with phase behavior.

3b. The method of embodiment 2b, wherein the capture domain is coupled to the polypeptide with phase behavior via a linker.

4b. The method of embodiment 3b, wherein the linker is a peptide linker.

5b. The method of embodiment 4b, wherein the peptide linker comprises a protease cleavage site.

6b. The method of embodiment 3b, wherein the linker is a chemical linker.

7b. The method of embodiment 1b, wherein the purification matrix comprises a fusion protein comprising (i) a capture domain which binds to the biologic and (ii) a polypeptide with phase behavior.

8b. The method of any one of embodiments 2b-7b, wherein the polypeptide with phase behavior is a resilin-like polypeptide.

9b. The method of any one of embodiments 2b-7b, wherein the polypeptide with phase behavior is an elastin-like polypeptide.

10b. The method of any one of 2b-7b or 9b, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

11b. The method of embodiment 10b, wherein n is an integer from 1 to 360, inclusive of endpoints.

12b. The method of any one of embodiments 2b-7b or 9b, wherein the polypeptide with phase behavior comprises an amino acid sequence selected from:

a.
(GRGDSPY)$_n$ (SEQ ID NO: 1)

b.
(GRGDSPH)$_n$ (SEQ ID NO: 2)

c.
(GRGDSPV)$_n$ (SEQ ID NO: 3)

d.
(GRGDSPYG)$_n$ (SEQ ID NO: 4)

e.
(RPLGYDS)$_n$ (SEQ ID NO: 5)

f.
(RPAGYDS)$_n$ (SEQ ID NO: 6)

g.
(GRGDSYP)$_n$ (SEQ ID NO: 7)

h.
(GRGDSPYQ)$_n$ (SEQ ID NO: 8)

i.
(GRGNSPYG)$_n$ (SEQ ID NO: 9)

j.
(GVGVP)$_n$; (SEQ ID NO: 11)

k.
(GVGVPGLGVPGVGVPGLGVPGVGVP)$_m$; (SEQ ID NO: 12)

l.
(GVGVPGVGVPGAGVPGVGVPGVGVP)$_m$; (SEQ ID NO: 13)

m.
(GVGVPGWGVPGVGVPGWGVPGVGVP)$_m$; (SEQ ID NO: 14)

n.
(GVGVPGVGVPGVGVPGVGVPGVGVP GVGVPGEGVPGFGVPGVGVP)$_m$; (SEQ ID NO: 15)

o.
(GVGVPGVGVPGVGVPGVGVPGVGVP GVGVPGKGVPGFGVPGVGVP)$_m$; (SEQ ID NO: 16)
and p.
(GAGVPGVGVPGAGVPGVGVPGAGVP)$_m$; (SEQ ID NO: 17)

or a randomized, scrambled analog thereof;
wherein:
n is an integer in the range of 20-360, inclusive of endpoints; and
m is an integer in the range of 4-25, inclusive of endpoints.

13b. The method of any one of embodiments 2b-7b or 9b, wherein the polypeptide with phase behavior comprises an amino acid sequence selected from:

a.
(GVGVP)$_m$; (SEQ ID NO: 52)

b.
(ZZPXXXXGZ)$_m$; (SEQ ID NO: 57)

c.
(ZZPXGZ)$_m$; (SEQ ID NO: 58)

d.
(ZZPXXGZ)$_m$; (SEQ ID NO: 59)

-continued or e.

(ZZPXXXGZ)$_m$, (SEQ ID NO: 60)

wherein m is an integer between 10 and 160, inclusive of endpoints, wherein X if present is any amino acid except proline or glycine, and wherein Z if present is any amino acid.

14b. The method of any one of embodiments 2b-7b or 9b, wherein the polypeptide with phase behavior comprises an amino acid sequence selected from:

(a)

(GVGVPGVGVPGAGVPGVGVPGVGVP)$_m$; or (SEQ ID NO: 53)

(b)

(GVGVPGVGVPGLGVPGVGVPGVGVP)$_m$; (SEQ ID NO: 55)

wherein m is an integer between 2 and 32, inclusive of endpoints.

15b. The method of any one of embodiments 2b-7b or 9b, wherein the polypeptide with phase behavior comprises an amino acid sequence selected from:
    (a) (GVGVPGVGVPGAGVPGVGVPGVGVP)$_m$ (SEQ ID NO: 193), wherein m is 8 or 16;
    (b) (GVGVPGAGVP)$_m$ (SEQ ID NO: 54), wherein m is an integer between 5 and 80, inclusive of endpoints; or
    (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

16b. The method of any one of embodiments 2b-15b, wherein the capture domain comprises the sequence of any one of SEQ ID NO: 24-49, 62-148, or 167-171 or a sequence having at least 1, at least 2, at least 3, at least 4, or at least 5 mutations relative thereto.

17b. The method of any one of embodiments 1b-16b, wherein the binding of the biologic to the purification matrix is reversible.

18b. The method of any one of embodiments 1b-16b, wherein the binding of the biologic to the purification matrix is non-covalent.

19b. The method of any one of embodiments 1b-16b, wherein the binding of the biologic to the purification matrix is covalent.

20b. The method of any one of embodiments 1b-19b, wherein the biologic is a lipid, lipopolysaccharide, cell, a protein, a nucleic acid, a carbohydrate, or a viral particle.

21b. The method of embodiment 20b, wherein the biologic is a cell.

22b. The method of embodiment 21b, wherein the cell is a bacterial cell, a yeast cell, or a mammalian cell.

23b. The method of embodiment 21b or 22b, wherein the cell is a stem cell, a bone cell, a blood cell, a muscle cell, a fat cell, a skin cell, a nerve cell, an endothelial cell, a sex cell, a pancreatic cell, or a cancer cell.

24b. The method of any one of embodiments 21b or 22b, wherein the cell is an immune cell.

25b. The method of embodiment 24b, wherein the immune cell is a T cell, a B cell, a NK cell, a peripheral blood mononuclear cell, or a neutrophil.

26b. The method of embodiment 25b, wherein the cell is a T cell expressing a chimeric antigen receptor (CAR).

27b. The method of embodiment 20b, wherein the nucleic acid is a DNA or an RNA.

28b. The method of embodiment 20b, wherein the virus is an adenovirus particle, an adeno-associated virus (AAV) particle, a lentivirus particle, a retrovirus particle, a poxvirus particle, a measles virus particle, or a herpesvirus particle.

29b. The method of any one of embodiments 1b-28b, wherein the biologic has a diameter between 1 nm and 100 µm, inclusive of the endpoints.

30b. The method of embodiment 29b, wherein the biologic has a diameter between 1 nm and 100 nm, inclusive of the endpoints.

31b. The method of embodiment 29b, wherein the biologic has a diameter between 100 nm and 1 µm, inclusive of the endpoints.

32b. The method of embodiment 29b, wherein the biologic has a diameter between 1 µm and 50 µm, inclusive of the endpoints.

33b. The method of embodiment 29b, wherein the biologic has a diameter between 50 µm and 100 µm, inclusive of the endpoints.

34b. The method of any one of embodiments 1b-33b, wherein the method is completed in about 0.5 to about 24 hours.

35b. The method of embodiment 34b, wherein the method is completed in about 0.5 to about 8 hours.

36b. The method of embodiment 34b, wherein the method is completed in about 2 to about 6 hours.

37b. The method of any one of embodiments 1b-36b, wherein the separation of the complex from the at least one contaminant can be observed visually with an unaided eye.

38b. The method of any one of embodiments 1b-37b, wherein the increase in the size of the complex is at least a 2-fold increase.

39b. The method of embodiment 38b, wherein the increase in the size of the complex is at least a 10-fold increase.

40b. The method of embodiment 39b, wherein the increase in the size of the complex is at least a 25-fold increase.

41b. The method of any one of embodiments 38b-40b, wherein the increase in size is an increase in the mass of the complex.

42b. The method of any one of embodiments 38b-40b, wherein the increase in size is an increase in the diameter of the complex.

43b. The method of any one of embodiments 1b-42b, wherein the environmental factor comprises one or more of:
    a. a change in one or more of temperature, pH, salt concentration, concentration of the purification matrix, concentration of the biologic, or pressure;
    b. the addition of one or more surfactants, molecular crowding agents, reducing agents, oxidizing agents, enzymes, cofactor, vitamin, or denaturing agents; or
    c. the application of electromagnetic or acoustic waves.

44b. The method of any one of embodiments 1b-43b, wherein the separation on the basis of size is performed using tangential flow filtration, analytical ultracentrifugation, membrane chromatography, high performance liquid chromatography, normal flow filtration, acoustic wave separation, centrifugation, counterflow centrifugation, and fast protein liquid chromatography.

45b. The method of any one of embodiments 1b-44b, wherein the at least one contaminant is selected from a solvent, an endotoxin, a protein, a peptide, a nucleic acid, and a carbohydrate.

46b. The method of any one of embodiments 1b-45b, wherein the purification yield of the biologic is at least 70%, at least 80%, at least 90%, at least 95%, at least 96%, at least 97%, at least 98%, or at least 99%.

47b. The method of any one of embodiments 1b-46b, wherein the biologic is purified to at least 70%, at least 80%, at least 90%, at least 95%, at least 96%, at least 97%, at least 98%, or at least 99% purity.

Method of Separating a First Biologic from a Second Biologic

1c. A method of separating a first biologic from a second biologic, the method comprising contacting the first biologic with a first protein-based purification matrix and contacting the second biologic with a second protein-based purification matrix; wherein the first biologic binds to the first purification matrix to form a first complex; wherein the second biologic binds to the second purification matrix to form a second complex; and separating the first biologic from the second biologic by applying an environmental factor.

2c. The method of embodiment 1c, wherein the first purification matrix comprises (i) a capture domain which binds to the biologic, and (ii) a polypeptide with phase behavior, wherein the capture domain is coupled to the polypeptide with phase behavior.

3c. The method of embodiment 1c, wherein the second purification matrix comprises (i) a capture domain which binds to the biologic, and (ii) a polypeptide with phase behavior, wherein the capture domain is coupled to the polypeptide with phase behavior.

4c. The method of embodiment 2c or 3c, wherein the capture domain is coupled to the polypeptide with phase behavior via a linker.

5c. The method of embodiment 4c, wherein the linker is a peptide linker.

6c. The method of embodiment 5c, wherein the peptide linker comprises a protease cleavage site.

7c. The method of embodiment 4c, wherein the linker is a chemical linker.

8c. The method of embodiment 1c, wherein the first purification matrix comprises a fusion protein comprising (i) a capture domain which binds to the biologic and (ii) a polypeptide with phase behavior.

9c. The method of embodiment 2c, wherein the second purification matrix comprises a fusion protein comprising (i) a capture domain which binds to the biologic and (ii) a polypeptide with phase behavior.

10c. The method of any one of embodiments 2c-9c, wherein the polypeptide with phase behavior is a resilin-like polypeptide.

11c. The method of any one of embodiments 2c-9c, wherein the polypeptide with phase behavior is an elastin-like polypeptide.

12c. The method of any one of embodiments 2c-9c or 11c, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

13c. The method of embodiment 12c, wherein n is an integer from 1 to 360, inclusive of endpoints.

14c. The method of any one of embodiments embodiments 2c-9c or 11c, wherein the polypeptide with phase behavior comprises an amino acid sequence selected from:

a.
(GRGDSPY)$_n$ (SEQ ID NO: 1)

b.
(GRGDSPH)$_n$ (SEQ ID NO: 2)

c.
(GRGDSPV)$_n$ (SEQ ID NO: 3)

d.
(GRGDSPYG)$_n$ (SEQ ID NO: 4)

e.
(RPLGYDS)$_n$ (SEQ ID NO: 5)

f.
(RPAGYDS)$_n$ (SEQ ID NO: 6)

g.
(GRGDSYP)$_n$ (SEQ ID NO: 7)

h.
(GRGDSPYQ)$_n$ (SEQ ID NO: 8)

i.
(GRGNSPYG)$_n$ (SEQ ID NO: 9)

j.
(GVGVP)$_n$; (SEQ ID NO: 11)

k.
(GVGVPGLGVPGVGVPGLGVPGVGVP)$_m$; (SEQ ID NO: 12)

l.
(GVGVPGVGVPGAGVPGVGVPGVGVP)$_m$; (SEQ ID NO: 13)

m.
(GVGVPGWGVPGVGVPGWGVPGVGVP)$_m$; (SEQ ID NO: 14)

n.
(GVGVPGVGVPGVGVPGVGVPGVGVPGVGVPGEGVPGFGVPGVGVP)$_m$; (SEQ ID NO: 15)

o.
(GVGVPGVGVPGVGVPGVGVPGVGVPGVGVPGKGVPGFGVPGVGVP)$_m$; (SEQ ID NO: 16)
and p.
(GAGVPGVGVPGAGVPGVGVPGAGVP)$_m$; (SEQ ID NO: 17)

or a randomized, scrambled analog thereof;
wherein:
n is an integer in the range of 20-360, inclusive of endpoints; and
m is an integer in the range of 4-25, inclusive of endpoints.

15c. The method of any one of embodiments 2c-9c or 11c, wherein the polypeptide with phase behavior comprises an amino acid sequence selected from:

a.
(GVGVP)$_m$; (SEQ ID NO: 52)

-continued b.
(ZZPXXXGZ)$_m$; (SEQ ID NO: 57)

c.
(ZZPXGZ)$_m$; (SEQ ID NO: 58)

d.
(ZZPXXGZ)$_m$; or (SEQ ID NO: 59)

e.
(ZZPXXXGZ)$_m$, (SEQ ID NO: 60)

wherein m is an integer between 10 and 160, inclusive of endpoints, wherein X if present is any amino acid except proline or glycine, and wherein Z if present is any amino acid.

16c. The method of any one of embodiments 2c-9c or 11c, wherein the polypeptide with phase behavior comprises an amino acid sequence selected from:

(a)
(GVGVPGVGVPGAGVPGVGVPGVGVP)$_m$; or (SEQ ID NO: 53)

(b)
(GVGVPGVGVPGLGVPGVGVPGVGVP)$_m$; (SEQ ID NO: 55)

wherein m is an integer between 2 and 32, inclusive of endpoints.

17c. The method of any one of embodiments 2c-9c or 11c, wherein the polypeptide with phase behavior comprises an amino acid sequence selected from:
  (a) (GVGVPGVGVPGAGVPGVGVPGVGVP)$_m$ (SEQ ID NO: 193), wherein m is 8 or 16;
  (b) (GVGVPGAGVP)$_m$ (SEQ ID NO: 54), wherein m is an integer between 5 and 80, inclusive of endpoints; or
  (c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

18c. The method of any one of embodiments 2c-17c, wherein the capture domain comprises the sequence of any one of SEQ ID NO: 24-49 and 62-148 and 167-171, or a sequence having at least 1, at least 2, at least 3, at least 4, or at least 5 mutations relative thereto.

19c. The method of any one of embodiments 1c-17c, wherein the binding of the first biologic and/or the second biologic to the purification matrix is reversible.

20c. The method of any one of embodiments 1c-17c, wherein the binding of the first biologic and/or the second biologic to the purification matrix is non-covalent.

21c. The method of any one of embodiments 1c-17c, wherein the binding of the first biologic and/or the second biologic to the purification matrix is covalent.

22c. The method of any one of embodiments 1c-21c, wherein the first biologic and/or the second biologic is selected from a cell, a protein, a lipid, a lipopolysaccharide, a nucleic acid, or a viral particle.

23c. The method of embodiment 22c, wherein the first biologic and/or the second biologic is a cell.

24c. The method of embodiment 23c, wherein the cell is a bacterial cell, a yeast cell, or a mammalian cell.

25c. The method of embodiment 23c or 24c, wherein the cell is a stem cell, a bone cell, a blood cell, a muscle cell, a fat cell, a skin cell, a nerve cell, an endothelial cell, a sex cell, a pancreatic cell, or a cancer cell.

26c. The method of embodiment 23c or 24c, wherein the cell is an immune cell.

27c. The method of embodiment 26c, wherein the immune cell is a T cell, a B cell, a NK cell, a peripheral blood mononuclear cell, or a neutrophil.

28c. The method of embodiment 27c, wherein the cell is a T cell expressing a chimeric antigen receptor (CAR).

29c. The method of embodiment 22c, wherein the nucleic acid is a DNA or an RNA.

30c. The method of embodiment 22c, wherein the viral particle is an adenovirus particle, an adeno-associated virus (AAV) particle, a lentivirus particle, a retrovirus particle, a poxvirus particle, a measles virus particle or a herpesvirus particle.

31c. The method of any one of embodiments 1c-30c, wherein the first biologic and/or second biologic has a diameter between 1 nm and 100 μm, inclusive of the endpoints.

32c. The method of embodiment 31c, wherein the first biologic and/or second biologic has a diameter between 1 nm and 100 nm, inclusive of the endpoints.

33c. The method of embodiment 31c, wherein the first biologic and/or second biologic has a diameter between 100 nm and 1 μm, inclusive of the endpoints.

34c. The method of embodiment 31c, wherein the first biologic and/or second biologic has a diameter between 1 μm and 50 μm, inclusive of the endpoints.

35c. The method of embodiment 31c, wherein the first biologic and/or second biologic has a diameter between 50 μm and 100 μm, inclusive of the endpoints.

36c. The method of any one of embodiments 1c-35c, wherein the method is completed in about 0.5 to about 24 hours.

37c. The method of embodiment 36c, wherein the method is completed in about 0.5 to about 8 hours.

38c. The method of embodiment 36c, wherein the method is completed in about 2 to about 6 hours.

39c. The method of any one of embodiments 1c-38c, wherein the separation of the first complex from the second complex can be observed visually with an unaided eye.

40c. The method of any one of embodiments 1c-39c, wherein the increase in the size of the first complex and/or second complex is at least a 2-fold increase.

41c. The method of any one of embodiments 1c-40c, wherein the increase in the size of the first complex and/or second complex is at least a 10-fold increase.

42c. The method of any one of embodiments 1c-41c, wherein the increase in the size of the first complex and/or second complex is at least a 25-fold increase.

43c. The method of any one of embodiments 40c-42c, wherein the increase in size is an increase in the mass of the complex.

44c. The method of any one of embodiments 40c-42c, wherein the increase in size is an increase in the diameter of the complex.

45c. The method of any one of embodiments 1c-44c, wherein the environmental factor comprises one or more of:
  a. a change in one or more of temperature, pH, salt concentration, concentration of the purification matrix, concentration of the biologic, or pressure;

b. the addition of one or more surfactants, molecular crowding agents, reducing agents, oxidizing agents, enzymes, or denaturing agents; or c. the application of electromagnetic or acoustic waves.

46c. The method of any one of embodiments 1c-45c, wherein the separation on the basis of size is performed using tangential flow filtration, analytical ultracentrifugation, membrane chromatography, high performance liquid chromatography, and fast protein liquid chromatography.

47c. The method of any one of embodiments 1c-46c, wherein the purification yield of the first biologic is at least 70%, at least 80%, at least 90%, at least 95%, at least 96%, at least 97%, at least 98%, or at least 99%.

48c. The method of any one of embodiments 1c-47c, wherein the purification yield of the second biologic is at least 70%, at least 80%, at least 90%, at least 95%, at least 96%, at least 97%, at least 98%, or at least 99%.

A Method of Bringing a First Biologic into Proximity with a Second Biologic

1d. A method of bringing a first biologic into proximity with a second biologic, the method comprising contacting the first biologic with a first protein-based purification matrix and contacting the second biologic with a second protein-based purification matrix;

wherein the first biologic binds to the first purification matrix to form a first complex;

wherein the second biologic binds to the second purification matrix to form a second complex; and wherein an environmental factor brings the first complex and the second complex into proximity with one another.

2d. The method of embodiment 1d, wherein the first purification matrix comprises (i) a capture domain which binds to the biologic, and (ii) a polypeptide with phase behavior, wherein the capture domain is coupled to the polypeptide with phase behavior.

3d. The method of embodiment 1d, wherein the second purification matrix comprises (i) a capture domain which binds to the biologic, and (ii) a polypeptide with phase behavior, wherein the capture domain is coupled to the polypeptide with phase behavior.

4d. The method of embodiment 2d or 3d, wherein the capture domain is coupled to the polypeptide with phase behavior via a linker.

5d. The method of embodiment 4d, wherein the linker is a peptide linker.

6d. The method of embodiment 5d, wherein the peptide linker comprises a protease cleavage site.

7d. The method of embodiment 4d, wherein the linker is a chemical linker.

8d. The method of embodiment 1d, wherein the first purification matrix comprises a fusion protein comprising (i) a capture domain which binds to the biologic and (ii) a polypeptide with phase behavior.

9d. The method of embodiment 1d, wherein the second purification matrix comprises a fusion protein comprising (i) a capture domain which binds to the biologic and (ii) a polypeptide with phase behavior.

10d. The method of any one of embodiments 1d-9d, wherein the polypeptide with phase behavior is a resilin-like polypeptide.

11d. The method of any one of embodiments 1d-9d, wherein the polypeptide with phase behavior is an elastin-like polypeptide.

12d. The method of any one of embodiments 1d-9d or 11d, wherein the polypeptide with phase behavior is a polymer containing a pentapeptide repeat having the sequence (Val-Pro-Gly-Xaa-Gly)$_n$ (SEQ ID NO: 10), or a randomized, scrambled analog thereof; wherein Xaa can be any amino acid except proline.

13d. The method of embodiment 12d, wherein n is an integer from 1 to 360, inclusive of endpoints.

14d. The method of any one of embodiments 1d-9d or 11d, wherein the polypeptide with phase behavior comprises an amino acid sequence selected from:

a.
(SEQ ID NO: 1)
(GRGDSPY)$_n$ b.
(SEQ ID NO: 2)
(GRGDSPH)$_n$ c.
(SEQ ID NO: 3)
(GRGDSPV)$_n$ d.
(SEQ ID NO: 4)
(GRGDSPYG)$_n$ e.
(SEQ ID NO: 5)
(RPLGYDS)$_n$ f.
(SEQ ID NO: 6)
(RPAGYDS)$_n$ g.
(SEQ ID NO: 7)
(GRGDSYP)$_n$ h.
(SEQ ID NO: 8)
(GRGDSPYQ)$_n$ i.
(SEQ ID NO: 9)
(GRGNSPYG)$_n$ j.
(SEQ ID NO: 11)
(GVGVP)$_n$;

k.
(SEQ ID NO: 12)
(GVGVPGLGVPGVGVPGLGVPGVGVP)$_m$;

l.
(SEQ ID NO: 13)
(GVGVPGVGVPGAGVPGVGVPGVGVP)$_m$;

m.
(SEQ ID NO: 14)
(GVGVPGWGVPGVGVPGWGVPGVGVP)$_m$;

n.
(SEQ ID NO: 15)
(GVGVPGVGVPGVGVPGVGVPGVGVPGVGVPGEGVPGFGVPGVGVP)$_m$;

o.
(SEQ ID NO: 16)
(GVGVPGVGVPGVGVPGVGVPGVGVPGVGVPGKGVPGFGVPGVGVP)$_m$;

and p.
(SEQ ID NO: 17)
(GAGVPGVGVPGAGVPGVGVPGAGVP)$_m$;

or a randomized, scrambled analog thereof;

wherein:

n is an integer in the range of 20-360, inclusive of endpoints; and m is an integer in the range of 4-25, inclusive of endpoints.

15d. The method of any one of embodiments 1d-9d or 11d, wherein the polypeptide with phase behavior comprises an amino acid sequence selected from:

a.
(GVGVP)$_m$; (SEQ ID NO: 52)

b.
(ZZPXXXGZ)$_m$; (SEQ ID NO: 57)

c.
(ZZPXGZ)$_m$; (SEQ ID NO: 58)

d.
(ZZPXXGZ)$_m$; (SEQ ID NO: 59)
or e.
(ZZPXXXGZ)$_m$, (SEQ ID NO: 60)

wherein m is an integer between 10 and 160, inclusive of endpoints, wherein X if present is any amino acid except proline or glycine, and wherein Z if present is any amino acid.

16d. The method of any one of embodiments 1d-9d or 11d, wherein the polypeptide with phase behavior comprises an amino acid sequence selected from:

(a)
(GVGVPGVGVPGAGVPGVGVPGVGVP)$_m$; or (SEQ ID NO: 53)

(b)
(GVGVPGVGVPGLGVPGVGVPGVGVP)$_m$; (SEQ ID NO: 55)

wherein m is an integer between 2 and 32, inclusive of endpoints.

17d. The method of any one of embodiments 1d-9d or 11d, wherein the polypeptide with phase behavior comprises an amino acid sequence selected from:
(a) (GVGVPGVGVPGAGVPGVGVPGVGVP)$_m$ (SEQ ID NO: 193), wherein m is 8 or 16;
(b) (GVGVPGAGVP)$_m$ (SEQ ID NO: 54), wherein m is an integer between 5 and 80, inclusive of endpoints; or
(c) (GXGVP)$_m$ (SEQ ID NO: 56), wherein m is an integer between 10 and 160, inclusive of endpoints, and wherein X for each repeat is independently selected from the group consisting of glycine, alanine, valine, isoleucine, leucine, phenylalanine, tyrosine, tryptophan, lysine, arginine, aspartic acid, glutamic acid, and serine.

18d. The method of any one of embodiments 2d-17d, wherein the capture domain comprises the sequence of any one of SEQ ID NO: 24-49 and 62-148 and 167-171, or a sequence having at least 1, at least 2, at least 3, at least 4, or at least 5 mutations relative thereto.

19d. The method of any one of embodiments 1d-18d, wherein the binding of the first biologic and/or second biologic to the purification matrix is reversible.

20d. The method of any one of embodiments 1d-18d, wherein the binding of the first biologic and/or second biologic to the purification matrix is non-covalent.

21d. The method of any one of embodiments 1d-18d, wherein the binding of the first biologic and/or second biologic to the purification matrix is covalent.

22d. The method of any one of embodiments 1d-21d, wherein the first biologic and/or second biologic is selected from a cell, a protein, a lipid, a lipopolysaccharide, a nucleic acid, a carbohydrate, or a viral particle.

23d. The method of embodiment 22d, wherein the first biologic and/or second biologic is a cell.

24d. The method of embodiment 23d, wherein the cell is a bacterial cell, a yeast cell, or a mammalian cell.

25d. The method of embodiment 23d or 24d, wherein the cell is a stem cell, a bone cell, a blood cell, a muscle cell, a fat cell, a skin cell, a nerve cell, an endothelial cell, a sex cell, a pancreatic cell, or a cancer cell.

26d. The method of any one of embodiments 23d or 24d, wherein the cell is an immune cell.

27d. The method of embodiment 26d, wherein the immune cell is a T cell, a B cell, a NK cell, a peripheral blood mononuclear cell, or a neutrophil.

28d. The method of embodiment 27d, wherein the cell is a T cell expressing a chimeric antigen receptor (CAR).

29d. The method of embodiment 22d, wherein the nucleic acid is a DNA or an RNA.

30d. The method of embodiment 22d, wherein the viral particle is an adenovirus particle, an adeno-associated virus (AAV) particle, a lentivirus particle, a retrovirus particle, a poxvirus particle, a measles virus particle, or a herpesvirus particle.

31d. The method of any one of embodiments 1d-30d, wherein the first biologic and/or second biologic has a diameter between 1 nm and 100 μm, inclusive of the endpoints.

32d. The method of embodiment 31d, wherein the first biologic and/or second biologic has a diameter between 1 nm and 100 nm, inclusive of the endpoints.

33d. The method of embodiment 31d, wherein the first biologic and/or second biologic has a diameter between 100 nm and 1 μm, inclusive of the endpoints.

34d. The method of embodiment 31d, wherein the first biologic and/or second biologic has a diameter between 1 μm and 50 μm, inclusive of the endpoints.

35d. The method of embodiment 31d, wherein the first biologic and/or second biologic has a diameter between 50 μm and 100 μm, inclusive of the endpoints.

36d. The method of any one of embodiments 1d-35d, wherein the method is completed in about 0.5 to about 24 hours.

37d. The method of embodiment 36d, wherein the method is completed in about 0.5 to about 8 hours.

38d. The method of embodiment 36d, wherein the method is completed in about 2 to about 6 hours.

39d. The method of any one of embodiments 1d-38d, wherein the bringing together of the first complex and the second complex can be observed visually with an unaided eye.

40d. The method of any one of embodiments 1d-39d, wherein the increase in the size of the first complex and/or second complex is at least a 2-fold increase.

41d. The method of any embodiment 40d, wherein the increase in the size of the first complex and/or second complex is at least a 10-fold increase.

42d. The method of embodiment 41d, wherein the increase in the size of the first complex and/or second complex is at least a 25-fold increase.

43d. The method of any one of embodiments 40d-42d, wherein the increase in size is an increase in the mass of the complex.

44d. The method of any one of embodiments 40d-42d, wherein the increase in size is an increase in the diameter of the complex.

45d. The method of any one of embodiments 1d-44d, wherein the environmental factor comprises one or more of:
a. a change in one or more of temperature, pH, salt concentration, concentration of the purification matrix, concentration of the biologic, or pressure;
b. the addition of one or more surfactants, molecular crowding agents, reducing agents, oxidizing agents, cofactor, vitamin, enzymes, or denaturing agents; or
c. the application of electromagnetic or acoustic waves.

46d. The method of any one of embodiments 1d-45d, wherein the separation on the basis of size is performed using tangential flow filtration, membrane chromatography, analytical ultracentrifugation, high performance liquid chromatography, normal flow filtration, acoustic wave separation, centrifugation, counterflow centrifugation, and fast protein liquid chromatography.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that it constitutes valid prior art or form part of the common general knowledge in any country in the world.

SEQUENCE LISTING (193 sequences)

SEQ ID NO: 1 - protein, 2520 aa, Artificial Sequence
  resilin-like polypeptide
  SITE (141)..(2520): May be present or absent in groups of the repeat unit Gly Arg Gly Asp Ser Pro Tyr
GRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPY

SEQ ID NO: 2 - protein, 2520 aa, Artificial Sequence
  resilin-like polypeptide
  SITE (141)..(2520): May be present or absent in groups of the repeat unit Gly Arg Gly Asp Ser Pro His
GRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPH

SEQ ID NO: 3 - protein, 2520 aa, Artificial Sequence
  resilin-like polypeptide
  SITE (141)..(2520): May be present or absent in groups of the repeat unit Gly Arg Gly Asp Ser Pro Val
GRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPV

SEQ ID NO: 4 - protein, 2880 aa, Artificial Sequence
  resilin-like polypeptide
  SITE (161)..(2880): May be present or absent in groups of the repeat unit Gly Arg Gly Asp Ser Pro Tyr Gly
GRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYG

SEQ ID NO: 5 - protein, 2520 aa, Artificial Sequence
  resilin-like polypeptide
  SITE (141)..(2520): May be present or absent in groups of the repeat unit Arg Pro Leu Gly Tyr Asp Ser
RPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDS

SEQ ID NO: 6 - protein, 2520 aa, Artificial Sequence
  resilin-like polypeptide
  SITE (141)..(2520): May be present or absent in groups of the repeat unit Arg Pro Ala Gly Tyr Asp Ser
RPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDS

SEQ ID NO: 7 - protein, 2520 aa, Artificial Sequence
  resilin-like polypeptide
  SITE (141)..(2520): May be present or absent in groups of the repeat unit Gly Arg Gly Asp Ser Tyr Pro
GRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYP

SEQ ID NO: 8 - protein, 2880 aa, Artificial Sequence
  resilin-like polypeptide
  SITE (161)..(2880): May be present or absent in groups of the repeat unit Gly Arg Gly Asp Ser Pro Tyr Gln
GRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQ

SEQ ID NO: 9 - protein, 2880 aa, Artificial Sequence
  resilin-like polypeptide
  SITE (161)..(2880): May be present or absent in groups of the repeat unit Gly Arg Gly Asn Ser Pro Tyr Gly
GRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYG

SEQ ID NO: 10 - protein, 1800 aa, Artificial Sequence
  elastin-like polypeptide
  SITE (4)..(4): Xaa can be any amino acid except proline
  SITE (6)..(1800): May be present or absent in groups of the repeat unit Val Pro Gly Xaa Gly
  SITE (9)..(9): Xaa can be any amino acid except proline
  SITE (14)..(14): Xaa can be any amino acid except proline
  SITE (19)..(19): Xaa can be any amino acid except proline
  SITE (24)..(24): Xaa can be any amino acid except proline
  SITE (29)..(29): Xaa can be any amino acid except proline
  SITE (34)..(34): Xaa can be any amino acid except proline
  SITE (39)..(39): Xaa can be any amino acid except proline
  SITE (44)..(44): Xaa can be any amino acid except proline
  SITE (49)..(49): Xaa can be any amino acid except proline
  SITE (54)..(54): Xaa can be any amino acid except proline
  SITE (59)..(59): Xaa can be any amino acid except proline
  SITE (64)..(64): Xaa can be any amino acid except proline
  SITE (69)..(69): Xaa can be any amino acid except proline
  SITE (74)..(74): Xaa can be any amino acid except proline
  SITE (79)..(79): Xaa can be any amino acid except proline
  SITE (84)..(84): Xaa can be any amino acid except proline
  SITE (89)..(89): Xaa can be any amino acid except proline
  SITE (94)..(94): Xaa can be any amino acid except proline
  SITE (99)..(99): Xaa can be any amino acid except proline
  SITE (104)..(104): Xaa can be any amino acid except proline
  SITE (109)..(109): Xaa can be any amino acid except proline
  SITE (114)..(114): Xaa can be any amino acid except proline
  SITE (119)..(119): Xaa can be any amino acid except proline
  SITE (124)..(124): Xaa can be any amino acid except proline
  SITE (129)..(129): Xaa can be any amino acid except proline
  SITE (134)..(134): Xaa can be any amino acid except proline
  SITE (139)..(139): Xaa can be any amino acid except proline
  SITE (144)..(144): Xaa can be any amino acid except proline
  SITE (149)..(149): Xaa can be any amino acid except proline
  SITE (154)..(154): Xaa can be any amino acid except proline
  SITE (159)..(159): Xaa can be any amino acid except proline
  SITE (164)..(164): Xaa can be any amino acid except proline
  SITE (169)..(169): Xaa can be any amino acid except proline
  SITE (174)..(174): Xaa can be any amino acid except proline
  SITE (179)..(179): Xaa can be any amino acid except proline
  SITE (184)..(184): Xaa can be any amino acid except proline
  SITE (189)..(189): Xaa can be any amino acid except proline
  SITE (194)..(194): Xaa can be any amino acid except proline
  SITE (199)..(199): Xaa can be any amino acid except proline
  SITE (204)..(204): Xaa can be any amino acid except proline
  SITE (209)..(209): Xaa can be any amino acid except proline
  SITE (214)..(214): Xaa can be any amino acid except proline
  SITE (219)..(219): Xaa can be any amino acid except proline
  SITE (224)..(224): Xaa can be any amino acid except proline
  SITE (229)..(229): Xaa can be any amino acid except proline
  SITE (234)..(234): Xaa can be any amino acid except proline
  SITE (239)..(239): Xaa can be any amino acid except proline
  SITE (244)..(244): Xaa can be any amino acid except proline
  SITE (249)..(249): Xaa can be any amino acid except proline
  SITE (254)..(254): Xaa can be any amino acid except proline
  SITE (259)..(259): Xaa can be any amino acid except proline
  SITE (264)..(264): Xaa can be any amino acid except proline
  SITE (269)..(269): Xaa can be any amino acid except proline
  SITE (274)..(274): Xaa can be any amino acid except proline
  SITE (279)..(279): Xaa can be any amino acid except proline
  SITE (284)..(284): Xaa can be any amino acid except proline
  SITE (289)..(289): Xaa can be any amino acid except proline
  SITE (294)..(294): Xaa can be any amino acid except proline
  SITE (299)..(299): Xaa can be any amino acid except proline
  SITE (304)..(304): Xaa can be any amino acid except proline
  SITE (309)..(309): Xaa can be any amino acid except proline
  SITE (314)..(314): Xaa can be any amino acid except proline
  SITE (319)..(319): Xaa can be any amino acid except proline
  SITE (324)..(324): Xaa can be any amino acid except proline
  SITE (329)..(329): Xaa can be any amino acid except proline
  SITE (334)..(334): Xaa can be any amino acid except proline
  SITE (339)..(339): Xaa can be any amino acid except proline
  SITE (344)..(344): Xaa can be any amino acid except proline
  SITE (349)..(349): Xaa can be any amino acid except proline
  SITE (354)..(354): Xaa can be any amino acid except proline
  SITE (359)..(359): Xaa can be any amino acid except proline
  SITE (364)..(364): Xaa can be any amino acid except proline
  SITE (369)..(369): Xaa can be any amino acid except proline
  SITE (374)..(374): Xaa can be any amino acid except proline
  SITE (379)..(379): Xaa can be any amino acid except proline
  SITE (384)..(384): Xaa can be any amino acid except proline
  SITE (389)..(389): Xaa can be any amino acid except proline
  SITE (394)..(394): Xaa can be any amino acid except proline
  SITE (399)..(399): Xaa can be any amino acid except proline
  SITE (404)..(404): Xaa can be any amino acid except proline
  SITE (409)..(409): Xaa can be any amino acid except proline
  SITE (414)..(414): Xaa can be any amino acid except proline
  SITE (419)..(419): Xaa can be any amino acid except proline
  SITE (424)..(424): Xaa can be any amino acid except proline
  SITE (429)..(429): Xaa can be any amino acid except proline
  SITE (434)..(434): Xaa can be any amino acid except proline
  SITE (439)..(439): Xaa can be any amino acid except proline
  SITE (444)..(444): Xaa can be any amino acid except proline
  SITE (449)..(449): Xaa can be any amino acid except proline
  SITE (454)..(454): Xaa can be any amino acid except proline
  SITE (459)..(459): Xaa can be any amino acid except proline
  SITE (464)..(464): Xaa can be any amino acid except proline
  SITE (469)..(469): Xaa can be any amino acid except proline
  SITE (474)..(474): Xaa can be any amino acid except proline
  SITE (479)..(479): Xaa can be any amino acid except proline
  SITE (484)..(484): Xaa can be any amino acid except proline
  SITE (489)..(489): Xaa can be any amino acid except proline
  SITE (494)..(494): Xaa can be any amino acid except proline
  SITE (499)..(499): Xaa can be any amino acid except proline
  SITE (504)..(504): Xaa can be any amino acid except proline
  SITE (509)..(509): Xaa can be any amino acid except proline
  SITE (514)..(514): Xaa can be any amino acid except proline
  SITE (519)..(519): Xaa can be any amino acid except proline
  SITE (524)..(524): Xaa can be any amino acid except proline
  SITE (529)..(529): Xaa can be any amino acid except proline
  SITE (534)..(534): Xaa can be any amino acid except proline
  SITE (539)..(539): Xaa can be any amino acid except proline
  SITE (544)..(544): Xaa can be any amino acid except proline
  SITE (549)..(549): Xaa can be any amino acid except proline
  SITE (554)..(554): Xaa can be any amino acid except proline
  SITE (559)..(559): Xaa can be any amino acid except proline
  SITE (564)..(564): Xaa can be any amino acid except proline
  SITE (569)..(569): Xaa can be any amino acid except proline
  SITE (574)..(574): Xaa can be any amino acid except proline
  SITE (579)..(579): Xaa can be any amino acid except proline
  SITE (584)..(584): Xaa can be any amino acid except proline
  SITE (589)..(589): Xaa can be any amino acid except proline
  SITE (594)..(594): Xaa can be any amino acid except proline
  SITE (599)..(599): Xaa can be any amino acid except proline
  SITE (604)..(604): Xaa can be any amino acid except proline
  SITE (609)..(609): Xaa can be any amino acid except proline
  SITE (614)..(614): Xaa can be any amino acid except proline
  SITE (619)..(619): Xaa can be any amino acid except proline
  SITE (624)..(624): Xaa can be any amino acid except proline
  SITE (629)..(629): Xaa can be any amino acid except proline
  SITE (634)..(634): Xaa can be any amino acid except proline
  SITE (639)..(639): Xaa can be any amino acid except proline
  SITE (644)..(644): Xaa can be any amino acid except proline
  SITE (649)..(649): Xaa can be any amino acid except proline
  SITE (654)..(654): Xaa can be any amino acid except proline
  SITE (659)..(659): Xaa can be any amino acid except proline
  SITE (664)..(664): Xaa can be any amino acid except proline
  SITE (669)..(669): Xaa can be any amino acid except proline
  SITE (674)..(674): Xaa can be any amino acid except proline
  SITE (679)..(679): Xaa can be any amino acid except proline
  SITE (684)..(684): Xaa can be any amino acid except proline
  SITE (689)..(689): Xaa can be any amino acid except proline
  SITE (694)..(694): Xaa can be any amino acid except proline
  SITE (699)..(699): Xaa can be any amino acid except proline
  SITE (704)..(704): Xaa can be any amino acid except proline
  SITE (709)..(709): Xaa can be any amino acid except proline
  SITE (714)..(714): Xaa can be any amino acid except proline
  SITE (719)..(719): Xaa can be any amino acid except proline
  SITE (724)..(724): Xaa can be any amino acid except proline
  SITE (729)..(729): Xaa can be any amino acid except proline
  SITE (734)..(734): Xaa can be any amino acid except proline
  SITE (739)..(739): Xaa can be any amino acid except proline
  SITE (744)..(744): Xaa can be any amino acid except proline
  SITE (749)..(749): Xaa can be any amino acid except proline
  SITE (754)..(754): Xaa can be any amino acid except proline
  SITE (759)..(759): Xaa can be any amino acid except proline
  SITE (764)..(764): Xaa can be any amino acid except proline
  SITE (769)..(769): Xaa can be any amino acid except proline
  SITE (774)..(774): Xaa can be any amino acid except proline
  SITE (779)..(779): Xaa can be any amino acid except proline
  SITE (784)..(784): Xaa can be any amino acid except proline
  SITE (789)..(789): Xaa can be any amino acid except proline
  SITE (794)..(794): Xaa can be any amino acid except proline
  SITE (799)..(799): Xaa can be any amino acid except proline
  SITE (804)..(804): Xaa can be any amino acid except proline
  SITE (809)..(809): Xaa can be any amino acid except proline
  SITE (814)..(814): Xaa can be any amino acid except proline
  SITE (819)..(819): Xaa can be any amino acid except proline
  SITE (824)..(824): Xaa can be any amino acid except proline
  SITE (829)..(829): Xaa can be any amino acid except proline
  SITE (834)..(834): Xaa can be any amino acid except proline
  SITE (839)..(839): Xaa can be any amino acid except proline
  SITE (844)..(844): Xaa can be any amino acid except proline
  SITE (849)..(849): Xaa can be any amino acid except proline
  SITE (854)..(854): Xaa can be any amino acid except proline
  SITE (859)..(859): Xaa can be any amino acid except proline
  SITE (864)..(864): Xaa can be any amino acid except proline
  SITE (869)..(869): Xaa can be any amino acid except proline
  SITE (874)..(874): Xaa can be any amino acid except proline
  SITE (879)..(879): Xaa can be any amino acid except proline
  SITE (884)..(884): Xaa can be any amino acid except proline
  SITE (889)..(889): Xaa can be any amino acid except proline
  SITE (894)..(894): Xaa can be any amino acid except proline
  SITE (899)..(899): Xaa can be any amino acid except proline
  SITE (904)..(904): Xaa can be any amino acid except proline
  SITE (909)..(909): Xaa can be any amino acid except proline
  SITE (914)..(914): Xaa can be any amino acid except proline
  SITE (919)..(919): Xaa can be any amino acid except proline
  SITE (924)..(924): Xaa can be any amino acid except proline
  SITE (929)..(929): Xaa can be any amino acid except proline
  SITE (934)..(934): Xaa can be any amino acid except proline
  SITE (939)..(939): Xaa can be any amino acid except proline
  SITE (944)..(944): Xaa can be any amino acid except proline
  SITE (949)..(949): Xaa can be any amino acid except proline
  SITE (954)..(954): Xaa can be any amino acid except proline
  SITE (959)..(959): Xaa can be any amino acid except proline
  SITE (964)..(964): Xaa can be any amino acid except proline
  SITE (969)..(969): Xaa can be any amino acid except proline
  SITE (974)..(974): Xaa can be any amino acid except proline
  SITE (979)..(979): Xaa can be any amino acid except proline
  SITE (984)..(984): Xaa can be any amino acid except proline
  SITE (989)..(989): Xaa can be any amino acid except proline
  SITE (994)..(994): Xaa can be any amino acid except proline
  SITE (999)..(999): Xaa can be any amino acid except proline
  SITE (1004)..(1004): Xaa can be any amino acid except proline
  SITE (1009)..(1009): Xaa can be any amino acid except proline
  SITE (1014)..(1014): Xaa can be any amino acid except proline
  SITE (1019)..(1019): Xaa can be any amino acid except proline
  SITE (1024)..(1024): Xaa can be any amino acid except proline
  SITE (1029)..(1029): Xaa can be any amino acid except proline
  SITE (1034)..(1034): Xaa can be any amino acid except proline
  SITE (1039)..(1039): Xaa can be any amino acid except proline
  SITE (1044)..(1044): Xaa can be any amino acid except proline
  SITE (1049)..(1049): Xaa can be any amino acid except proline
  SITE (1054)..(1054): Xaa can be any amino acid except proline
  SITE (1059)..(1059): Xaa can be any amino acid except proline
  SITE (1064)..(1064): Xaa can be any amino acid except proline
  SITE (1069)..(1069): Xaa can be any amino acid except proline
  SITE (1074)..(1074): Xaa can be any amino acid except proline
  SITE (1079)..(1079): Xaa can be any amino acid except proline
  SITE (1084)..(1084): Xaa can be any amino acid except proline
  SITE (1089)..(1089): Xaa can be any amino acid except proline
  SITE (1094)..(1094): Xaa can be any amino acid except proline
  SITE (1099)..(1099): Xaa can be any amino acid except proline
  SITE (1104)..(1104): Xaa can be any amino acid except proline
  SITE (1109)..(1109): Xaa can be any amino acid except proline
  SITE (1114)..(1114): Xaa can be any amino acid except proline
  SITE (1119)..(1119): Xaa can be any amino acid except proline
  SITE (1124)..(1124): Xaa can be any amino acid except proline
  SITE (1129)..(1129): Xaa can be any amino acid except proline
  SITE (1134)..(1134): Xaa can be any amino acid except proline
  SITE (1139)..(1139): Xaa can be any amino acid except proline
  SITE (1144)..(1144): Xaa can be any amino acid except proline
  SITE (1149)..(1149): Xaa can be any amino acid except proline
  SITE (1154)..(1154): Xaa can be any amino acid except proline
  SITE (1159)..(1159): Xaa can be any amino acid except proline
  SITE (1164)..(1164): Xaa can be any amino acid except proline
  SITE (1169)..(1169): Xaa can be any amino acid except proline
  SITE (1174)..(1174): Xaa can be any amino acid except proline
  SITE (1179)..(1179): Xaa can be any amino acid except proline
  SITE (1184)..(1184): Xaa can be any amino acid except proline
  SITE (1189)..(1189): Xaa can be any amino acid except proline
  SITE (1194)..(1194): Xaa can be any amino acid except proline
  SITE (1199)..(1199): Xaa can be any amino acid except proline
  SITE (1204)..(1204): Xaa can be any amino acid except proline
  SITE (1209)..(1209): Xaa can be any amino acid except proline
  SITE (1214)..(1214): Xaa can be any amino acid except proline
  SITE (1219)..(1219): Xaa can be any amino acid except proline
  SITE (1224)..(1224): Xaa can be any amino acid except proline
  SITE (1229)..(1229): Xaa can be any amino acid except proline
  SITE (1234)..(1234): Xaa can be any amino acid except proline
  SITE (1239)..(1239): Xaa can be any amino acid except proline
  SITE (1244)..(1244): Xaa can be any amino acid except proline
  SITE (1249)..(1249): Xaa can be any amino acid except proline
  SITE (1254)..(1254): Xaa can be any amino acid except proline
  SITE (1259)..(1259): Xaa can be any amino acid except proline
  SITE (1264)..(1264): Xaa can be any amino acid except proline
  SITE (1269)..(1269): Xaa can be any amino acid except proline
  SITE (1274)..(1274): Xaa can be any amino acid except proline
  SITE (1279)..(1279): Xaa can be any amino acid except proline
  SITE (1284)..(1284): Xaa can be any amino acid except proline
  SITE (1289)..(1289): Xaa can be any amino acid except proline
  SITE (1294)..(1294): Xaa can be any amino acid except proline
  SITE (1299)..(1299): Xaa can be any amino acid except proline
  SITE (1304)..(1304): Xaa can be any amino acid except proline
  SITE (1309)..(1309): Xaa can be any amino acid except proline
  SITE (1314)..(1314): Xaa can be any amino acid except proline
  SITE (1319)..(1319): Xaa can be any amino acid except proline
  SITE (1324)..(1324): Xaa can be any amino acid except proline
  SITE (1329)..(1329): Xaa can be any amino acid except proline
  SITE (1334)..(1334): Xaa can be any amino acid except proline
  SITE (1339)..(1339): Xaa can be any amino acid except proline
  SITE (1344)..(1344): Xaa can be any amino acid except proline
  SITE (1349)..(1349): Xaa can be any amino acid except proline
  SITE (1354)..(1354): Xaa can be any amino acid except proline
  SITE (1359)..(1359): Xaa can be any amino acid except proline
  SITE (1364)..(1364): Xaa can be any amino acid except proline
  SITE (1369)..(1369): Xaa can be any amino acid except proline
  SITE (1374)..(1374): Xaa can be any amino acid except proline
  SITE (1379)..(1379): Xaa can be any amino acid except proline
  SITE (1384)..(1384): Xaa can be any amino acid except proline
  SITE (1389)..(1389): Xaa can be any amino acid except proline
  SITE (1394)..(1394): Xaa can be any amino acid except proline
  SITE (1399)..(1399): Xaa can be any amino acid except proline
  SITE (1404)..(1404): Xaa can be any amino acid except proline
  SITE (1409)..(1409): Xaa can be any amino acid except proline
  SITE (1414)..(1414): Xaa can be any amino acid except proline
  SITE (1419)..(1419): Xaa can be any amino acid except proline
  SITE (1424)..(1424): Xaa can be any amino acid except proline
  SITE (1429)..(1429): Xaa can be any amino acid except proline
  SITE (1434)..(1434): Xaa can be any amino acid except proline
  SITE (1439)..(1439): Xaa can be any amino acid except proline
  SITE (1444)..(1444): Xaa can be any amino acid except proline
  SITE (1449)..(1449): Xaa can be any amino acid except proline
  SITE (1454)..(1454): Xaa can be any amino acid except proline
  SITE (1459)..(1459): Xaa can be any amino acid except proline
  SITE (1464)..(1464): Xaa can be any amino acid except proline
  SITE (1469)..(1469): Xaa can be any amino acid except proline
  SITE (1474)..(1474): Xaa can be any amino acid except proline
  SITE (1479)..(1479): Xaa can be any amino acid except proline
  SITE (1484)..(1484): Xaa can be any amino acid except proline
  SITE (1489)..(1489): Xaa can be any amino acid except proline
  SITE (1494)..(1494): Xaa can be any amino acid except proline
  SITE (1499)..(1499): Xaa can be any amino acid except proline
  SITE (1504)..(1504): Xaa can be any amino acid except proline
  SITE (1509)..(1509): Xaa can be any amino acid except proline
  SITE (1514)..(1514): Xaa can be any amino acid except proline
  SITE (1519)..(1519): Xaa can be any amino acid except proline
  SITE (1524)..(1524): Xaa can be any amino acid except proline
  SITE (1529)..(1529): Xaa can be any amino acid except proline
  SITE (1534)..(1534): Xaa can be any amino acid except proline
  SITE (1539)..(1539): Xaa can be any amino acid except proline
  SITE (1544)..(1544): Xaa can be any amino acid except proline
  SITE (1549)..(1549): Xaa can be any amino acid except proline
  SITE (1554)..(1554): Xaa can be any amino acid except proline
  SITE (1559)..(1559): Xaa can be any amino acid except proline
  SITE (1564)..(1564): Xaa can be any amino acid except proline
  SITE (1569)..(1569): Xaa can be any amino acid except proline
  SITE (1574)..(1574): Xaa can be any amino acid except proline
  SITE (1579)..(1579): Xaa can be any amino acid except proline
  SITE (1584)..(1584): Xaa can be any amino acid except proline
  SITE (1589)..(1589): Xaa can be any amino acid except proline
  SITE (1594)..(1594): Xaa can be any amino acid except proline
  SITE (1599)..(1599): Xaa can be any amino acid except proline
  SITE (1604)..(1604): Xaa can be any amino acid except proline
  SITE (1609)..(1609): Xaa can be any amino acid except proline
  SITE (1614)..(1614): Xaa can be any amino acid except proline
  SITE (1619)..(1619): Xaa can be any amino acid except proline
  SITE (1624)..(1624): Xaa can be any amino acid except proline
  SITE (1629)..(1629): Xaa can be any amino acid except proline
  SITE (1634)..(1634): Xaa can be any amino acid except proline
  SITE (1639)..(1639): Xaa can be any amino acid except proline
  SITE (1644)..(1644): Xaa can be any amino acid except proline
  SITE (1649)..(1649): Xaa can be any amino acid except proline
  SITE (1654)..(1654): Xaa can be any amino acid except proline
  SITE (1659)..(1659): Xaa can be any amino acid except proline
  SITE (1664)..(1664): Xaa can be any amino acid except proline
  SITE (1669)..(1669): Xaa can be any amino acid except proline
  SITE (1674)..(1674): Xaa can be any amino acid except proline
  SITE (1679)..(1679): Xaa can be any amino acid except proline
  SITE (1684)..(1684): Xaa can be any amino acid except proline
  SITE (1689)..(1689): Xaa can be any amino acid except proline
  SITE (1694)..(1694): Xaa can be any amino acid except proline
  SITE (1699)..(1699): Xaa can be any amino acid except proline
  SITE (1704)..(1704): Xaa can be any amino acid except proline
  SITE (1709)..(1709): Xaa can be any amino acid except proline
  SITE (1714)..(1714): Xaa can be any amino acid except proline
  SITE (1719)..(1719): Xaa can be any amino acid except proline
  SITE (1724)..(1724): Xaa can be any amino acid except proline
  SITE (1729)..(1729): Xaa can be any amino acid except proline
  SITE (1734)..(1734): Xaa can be any amino acid except proline
  SITE (1739)..(1739): Xaa can be any amino acid except proline
  SITE (1744)..(1744): Xaa can be any amino acid except proline
  SITE (1749)..(1749): Xaa can be any amino acid except proline
  SITE (1754)..(1754): Xaa can be any amino acid except proline
  SITE (1759)..(1759): Xaa can be any amino acid except proline
  SITE (1764)..(1764): Xaa can be any amino acid except proline
  SITE (1769)..(1769): Xaa can be any amino acid except proline
  SITE (1774)..(1774): Xaa can be any amino acid except proline
  SITE (1779)..(1779): Xaa can be any amino acid except proline
  SITE (1784)..(1784): Xaa can be any amino acid except proline
  SITE (1789)..(1789): Xaa can be any amino acid except proline
  SITE (1794)..(1794): Xaa can be any amino acid except proline
  SITE (1799)..(1799): Xaa can be any amino acid except proline
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

SEQ ID NO: 11 - protein, 1800 aa, Artificial Sequence
  elastin-like polypeptide
  SITE (6)..(1800): May be present or absent in groups of the repeat unit Gly Val Gly Val Pro
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 12 - protein, 625 aa, Artificial Sequence
  elastin-like polypeptide
  SITE (101)..(625): May be present or absent in groups of the repeat unit Gly Val Gly Val Pro Gly Leu Gly Val Pro Gly Val Gly Val Pro Gly Leu Gly Val Pro Gly Val Gly Val Pro
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 13 - protein, 625 aa, Artificial Sequence
  elastin-like polypeptide
  SITE (101)..(625): May be present or absent in groups of the repeat unit Gly Val Gly Val Pro Gly Val Gly Val Pro Gly Ala Gly Val Pro Gly Val Gly Val Pro Gly Val Gly Val Pro
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 14 - protein, 625 aa, Artificial Sequence
  elastin-like polypeptide
  SITE (101)..(625): May be present or absent in groups of the repeat unit Gly Val Gly Val Pro Gly Trp Gly Val Pro Gly Val Gly Val Pro Gly Trp Gly Val Pro Gly Val Gly Val Pro
GVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVPGVGVPGWGVPGVGVPGWGVPGVGVP

SEQ ID NO: 15 - protein, 1125 aa, Artificial Sequence
  elastin-like polypeptide
  SITE (181)..(1125): May be present or absent in groups of the repeat unit Gly Val Gly Val Pro Gly Val Gly Val Pro Gly Val Gly Val Pro Gly Val Gly Val Pro Gly Val Gly Val Pro Gly Val Gly Val Pro Gly Glu Gly Val Pro Gly Phe Gly Val Pro Gly Val Gly Val Pro
GVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVPGVGVPGVGVPGVGVPGVGVPGVGVPGVGVPGEGVPGFGVPGVGVP

SEQ ID NO: 16 - protein, 1125 aa, Artificial Sequence
  elastin-like polypeptide
  SITE (181)..(1125): May be present or absent in groups of the repeat unit Gly Val Gly Val Pro Gly Val Gly Val Pro Gly Val Gly Val Pro Gly Val Gly Val Pro Gly Val Gly Val Pro Gly Val Gly Val Pro Gly Lys Gly Val Pro Gly Phe Gly Val Pro Gly Val Gly Val Pro
GVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVPGVGVPGVGVPGVGVPGVGVPGVGVPGVGVPGKGVPGFGVPGVGVP

SEQ ID NO: 17 - protein, 625 aa, Artificial Sequence
  elastin-like polypeptide
  SITE (26)..(625): May be present or absent in groups of the repeat unit Gly Ala Gly Val Pro Gly Val Gly Val Pro Gly Ala Gly Val Pro Gly Val Gly Val Pro Gly Ala Gly Val Pro
GAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVPGAGVPGVGVPGAGVPGVGVPGAGVP

SEQ ID NO: 18 - protein, 100 aa, Artificial Sequence
  Linker peptide
  SITE (6)..(100): May be present or absent in groups of the repeat unit Glu Ala Ala Ala Lys
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 19 - protein, 150 aa, Artificial Sequence
  Linker peptide
  SITE (6)..(150): May be present or absent in groups of the repeat unit Gly Gly Gly Gly Ser
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 20 - protein, 200 aa, Artificial Sequence
  Linker peptide
  SITE (5)..(200): May be present or absent in groups of the repeat unit Ser Gly Gly Gly
SGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGG

SEQ ID NO: 21 - protein, 80 aa, Artificial Sequence
  Linker peptide
  SITE (5)..(80): May be present or absent in groups of the repeat unit Gly Gly Gly Ser
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 22 - protein, 18 aa, Artificial Sequence
  Linker peptide
KESGSVSSEQLAQFRSLD

SEQ ID NO: 23 - protein, 14 aa, Artificial Sequence
  Linker peptide
EGKSSGSGSESKST

SEQ ID NO: 24 - protein, 58 aa, Artificial Sequence [sequence omitted]

SEQ ID NO: 25 - protein, 59 aa, Artificial Sequence
  Capture domain
VDNKFNKEQQNAFYEILSLPNLNEEQRAAFIQSLKDDPSQSANLLAEAKKLNDAQAPKG

SEQ ID NO: 26 - protein, 59 aa, Artificial Sequence
  Capture domain
VDNKFNKEHQNAFYEILHLPNLNEEQRNAFIQSLKHDPSQSANLLAEAKKLNDAQAPKG

SEQ ID NO: 27 - protein, 254 aa, Artificial Sequence
  Capture domain
AQHDEAQQNAFYQVLNMPNLNADQRNGFIQSLKDDPSQSANVLGEAQKLNDSQAPKADAQQNKFNKDQQSAFYEILNMPNLNEEQRNGFIQSLKDDPSQSTNVLGEAKKLNESQAPKADNNFNKEQQNAFYEILNMPNLNEEQRNGFIQSLKDDPSQSANLLAEAKKLNESQAPKADNKFNKEQQNAFYEILHLPNLNEEQRNGFIQSLKDDPSQSANLLAEAKKLNDAQAPKADNKFNKEQQNAFYEILHLPN

SEQ ID NO: 28 - protein, 56 aa, Artificial Sequence
  Capture domain
TYKLILNGKTLKGETTTEAVDAATAEKVFKQYANDNGVDGEWTYDDATKTFTVTEG

SEQ ID NO: 29 - protein, 189 aa, Artificial Sequence
  Capture domain
KTDTYKLILNGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKDDAKKAET

SEQ ID NO: 30 - protein, 76 aa, Artificial Sequence
  Capture domain
KEETPETPETDSEEEVTIKANLIFANGSTQTAEFKGTFEKATSEAYAYADTLKKDNGEYTVDVADKGYTLNLKFAG

SEQ ID NO: 31 - protein, 7 aa, Artificial Sequence
  Capture domain
  SITE (5)..(5): Xaa can be Arg, His or Lys
  SITE (6)..(6): Xaa can be Arg or His
  SITE (7)..(7): Xaa can be Pro or Ser
GYVSXXX

SEQ ID NO: 32 - protein, 226 aa, Artificial Sequence
  Capture domain
SDVQLQESGPDLVKPSQSLSLTCTVTGYSITSGYTWHWIRQFPGNKQEWGYIHFSGYTNYNPSLKSRVSITRDTSKNQFFLHLNSVTTEDTATYYCARGDYGYEWFTYWGQGTLVTVSADIQMTQSSSSFSVSLGDRVTITCKASEDIHNRLAWYKQKPGNAPRLLISGATSLETGVPSRFSGSGSGKDYTLSITSLQNEDVATYYCQQYWIGPFTFGSGTNLEIK

SEQ ID NO: 33 - protein, 11 aa, Artificial Sequence
  Capture domain
GYVSRHPGGGC

SEQ ID NO: 34 - protein, 12 aa, Artificial Sequence
  Capture domain
GYVSRHPGGGGS

SEQ ID NO: 35 - protein, 11 aa, Artificial Sequence
  Capture domain
FHENWPSGGGC

SEQ ID NO: 36 - protein, 12 aa, Artificial Sequence
  Capture domain
FHENWPSGGGGS

SEQ ID NO: 37 - protein, 7 aa, Artificial Sequence
  Capture domain
GVVTINP

SEQ ID NO: 38 - protein, 7 aa, Artificial Sequence
  Capture domain
GLVTPSG

SEQ ID NO: 39 - protein, 7 aa, Artificial Sequence
  Capture domain
GYVSHRS

SEQ ID NO: 40 - protein, 7 aa, Artificial Sequence
  Capture domain
KVWILTP

SEQ ID NO: 41 - protein, 7 aa, Artificial Sequence
  Capture domain
KLWVIPQ

SEQ ID NO: 42 - protein, 479 aa, Artificial Sequence
  Capture domain
GVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRG

SEQ ID NO: 43 - protein, 90 aa, Artificial Sequence
  Capture domain
SAGESVQITLPKNEVQLNAYVLQEPPKGETYTYDWQLITHPRDYSGEMEGKHSQILKLSKLTPGLYEFKVIVEGQNAHGEGYVNVTVKPE

SEQ ID NO: 44 - protein, 90 aa, Artificial Sequence
  Capture domain
IAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 45 - protein, 190 aa, Artificial Sequence
  Capture domain
MGVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKA

SEQ ID NO: 46 - protein, 91 aa, Artificial Sequence
  Capture domain
VANAGPNQVITLPQNSITLFGNQSTDDHGITSYEWSLSPSSKGKVVEMQGVRTPTLQLSAMQEGDYTYQLTVTDTIGQQATAQVTVIVQPE

SEQ ID NO: 47 - protein, 89 aa, Artificial Sequence
  Capture domain
QADAGPDKELTLPVDSTTLDGSKSSDDQKIISYLWEKTQGPDGVQLENANSSVATVTGLQVGTYVFTLTVKDERNLQSQSSVNVIVKEE

SEQ ID NO: 48 - protein, 93 aa, Artificial Sequence
  Capture domain
IAKITGNVVITLPTSTAELDGSKSSDDKGIVSYLWTRDEGSPAAGEVLNHSDHHPILFLSNLVEGTYTFHLKVTDAKGESDTDRTTVEVKPDP

SEQ ID NO: 49 - protein, 46 aa, Artificial Sequence
  Capture domain
LAEAKVLANRELDKYGVSDYYKNLINNAKTVEGVKALIDEILAALP

SEQ ID NO: 50 - protein, 30 aa, Artificial Sequence
  Linker peptide
  SITE (2)..(30): Each individual Gly may be present or absent
GGGGGGGGGGGGGGGGGGGGGGGGGGGGGG

SEQ ID NO: 51 - protein, 1280 aa, Artificial Sequence
  elastin-like polypeptide
  SITE (1)..(1): Xaa is Gln or Ser
  SITE (2)..(2): Xaa is Tyr or Val
  SITE (4)..(4): Xaa is Gln or Ser
  SITE (9)..(9): Xaa is Gln or Ser
  SITE (10)..(10): Xaa is Tyr or Val
  SITE (12)..(12): Xaa is Gln or Ser
  SITE (17)..(17): Xaa is Gln or Ser
  SITE (18)..(18): Xaa is Tyr or Val
  SITE (20)..(20): Xaa is Gln or Ser
  SITE (25)..(25): Xaa is Gln or Ser
  SITE (26)..(26): Xaa is Tyr or Val
  SITE (28)..(28): Xaa is Gln or Ser
  SITE (33)..(33): Xaa is Gln or Ser
  SITE (34)..(34): Xaa is Tyr or Val
  SITE (36)..(36): Xaa is Gln or Ser
  SITE (41)..(41): Xaa is Gln or Ser
  SITE (42)..(42): Xaa is Tyr or Val
  SITE (44)..(44): Xaa is Gln or Ser
  SITE (49)..(49): Xaa is Gln or Ser
  SITE (50)..(50): Xaa is Tyr or Val
  SITE (52)..(52): Xaa is Gln or Ser
  SITE (57)..(57): Xaa is Gln or Ser
  SITE (58)..(58): Xaa is Tyr or Val
  SITE (60)..(60): Xaa is Gln or Ser
  SITE (65)..(65): Xaa is Gln or Ser
  SITE (66)..(66): Xaa is Tyr or Val
  SITE (68)..(68): Xaa is Gln or Ser
  SITE (73)..(73): Xaa is Gln or Ser
  SITE (74)..(74): Xaa is Tyr or Val
  SITE (76)..(76): Xaa is Gln or Ser
  SITE (81)..(1280): May be present or absent in groups of the repeat unit Xaa Xaa Pro Xaa Asp Gly Arg Gly
  SITE (81)..(81): Xaa is Gln or Ser
  SITE (82)..(82): Xaa is Tyr or Val
  SITE (84)..(84): Xaa is Gln or Ser
  SITE (89)..(89): Xaa is Gln or Ser
  SITE (90)..(90): Xaa is Tyr or Val
  SITE (92)..(92): Xaa is Gln or Ser
  SITE (97)..(97): Xaa is Gln or Ser
  SITE (98)..(98): Xaa is Tyr or Val
  SITE (100)..(100): Xaa is Gln or Ser
  SITE (105)..(105): Xaa is Gln or Ser
  SITE (106)..(106): Xaa is Tyr or Val
  SITE (108)..(108): Xaa is Gln or Ser
  SITE (113)..(113): Xaa is Gln or Ser
  SITE (114)..(114): Xaa is Tyr or Val
  SITE (116)..(116): Xaa is Gln or Ser
  SITE (121)..(121): Xaa is Gln or Ser
  SITE (122)..(122): Xaa is Tyr or Val
  SITE (124)..(124): Xaa is Gln or Ser
  SITE (129)..(129): Xaa is Gln or Ser
  SITE (130)..(130): Xaa is Tyr or Val
  SITE (132)..(132): Xaa is Gln or Ser
  SITE (137)..(137): Xaa is Gln or Ser
  SITE (138)..(138): Xaa is Tyr or Val
  SITE (140)..(140): Xaa is Gln or Ser
  SITE (145)..(145): Xaa is Gln or Ser
  SITE (146)..(146): Xaa is Tyr or Val
  SITE (148)..(148): Xaa is Gln or Ser
  SITE (153)..(153): Xaa is Gln or Ser
  SITE (154)..(154): Xaa is Tyr or Val
  SITE (156)..(156): Xaa is Gln or Ser
  SITE (161)..(161): Xaa is Gln or Ser
  SITE (162)..(162): Xaa is Tyr or Val
  SITE (164)..(164): Xaa is Gln or Ser
  SITE (169)..(169): Xaa is Gln or Ser
  SITE (170)..(170): Xaa is Tyr or Val
  SITE (172)..(172): Xaa is Gln or Ser
  SITE (177)..(177): Xaa is Gln or Ser
  SITE (178)..(178): Xaa is Tyr or Val
  SITE (180)..(180): Xaa is Gln or Ser
  SITE (185)..(185): Xaa is Gln or Ser
  SITE (186)..(186): Xaa is Tyr or Val
  SITE (188)..(188): Xaa is Gln or Ser
  SITE (193)..(193): Xaa is Gln or Ser
  SITE (194)..(194): Xaa is Tyr or Val
  SITE (196)..(196): Xaa is Gln or Ser
  SITE (201)..(201): Xaa is Gln or Ser
  SITE (202)..(202): Xaa is Tyr or Val
  SITE (204)..(204): Xaa is Gln or Ser
  SITE (209)..(209): Xaa is Gln or Ser
  SITE (210)..(210): Xaa is Tyr or Val
  SITE (212)..(212): Xaa is Gln or Ser
  SITE (217)..(217): Xaa is Gln or Ser
  SITE (218)..(218): Xaa is Tyr or Val
  SITE (220)..(220): Xaa is Gln or Ser
  SITE (225)..(225): Xaa is Gln or Ser
  SITE (226)..(226): Xaa is Tyr or Val
  SITE (228)..(228): Xaa is Gln or Ser
  SITE (233)..(233): Xaa is Gln or Ser
  SITE (234)..(234): Xaa is Tyr or Val
  SITE (236)..(236): Xaa is Gln or Ser
  SITE (241)..(241): Xaa is Gln or Ser
  SITE (242)..(242): Xaa is Tyr or Val
  SITE (244)..(244): Xaa is Gln or Ser
  SITE (249)..(249): Xaa is Gln or Ser
  SITE (250)..(250): Xaa is Tyr or Val
  SITE (252)..(252): Xaa is Gln or Ser
  SITE (257)..(257): Xaa is Gln or Ser
  SITE (258)..(258): Xaa is Tyr or Val
  SITE (260)..(260): Xaa is Gln or Ser
  SITE (265)..(265): Xaa is Gln or Ser
  SITE (266)..(266): Xaa is Tyr or Val
  SITE (268)..(268): Xaa is Gln or Ser
  SITE (273)..(273): Xaa is Gln or Ser
  SITE (274)..(274): Xaa is Tyr or Val
  SITE (276)..(276): Xaa is Gln or Ser
  SITE (281)..(281): Xaa is Gln or Ser
  SITE (282)..(282): Xaa is Tyr or Val
  SITE (284)..(284): Xaa is Gln or Ser
  SITE (289)..(289): Xaa is Gln or Ser
  SITE (290)..(290): Xaa is Tyr or Val
  SITE (292)..(292): Xaa is Gln or Ser
  SITE (297)..(297): Xaa is Gln or Ser
  SITE (298)..(298): Xaa is Tyr or Val
  SITE (300)..(300): Xaa is Gln or Ser
  SITE (305)..(305): Xaa is Gln or Ser
  SITE (306)..(306): Xaa is Tyr or Val
  SITE (308)..(308): Xaa is Gln or Ser
  SITE (313)..(313): Xaa is Gln or Ser
  SITE (314)..(314): Xaa is Tyr or Val
  SITE (316)..(316): Xaa is Gln or Ser
  SITE (321)..(321): Xaa is Gln or Ser
  SITE (322)..(322): Xaa is Tyr or Val
  SITE (324)..(324): Xaa is Gln or Ser
  SITE (329)..(329): Xaa is Gln or Ser
  SITE (330)..(330): Xaa is Tyr or Val
  SITE (332)..(332): Xaa is Gln or Ser
  SITE (337)..(337): Xaa is Gln or Ser
  SITE (338)..(338): Xaa is Tyr or Val
  SITE (340)..(340): Xaa is Gln or Ser
  SITE (345)..(345): Xaa is Gln or Ser
  SITE (346)..(346): Xaa is Tyr or Val
  SITE (348)..(348): Xaa is Gln or Ser
  SITE (353)..(353): Xaa is Gln or Ser
  SITE (354)..(354): Xaa is Tyr or Val
  SITE (356)..(356): Xaa is Gln or Ser
  SITE (361)..(361): Xaa is Gln or Ser
  SITE (362)..(362): Xaa is Tyr or Val
  SITE (364)..(364): Xaa is Gln or Ser
  SITE (369)..(369): Xaa is Gln or Ser
  SITE (370)..(370): Xaa is Tyr or Val
  SITE (372)..(372): Xaa is Gln or Ser
  SITE (377)..(377): Xaa is Gln or Ser
  SITE (378)..(378): Xaa is Tyr or Val
  SITE (380)..(380): Xaa is Gln or Ser
  SITE (385)..(385): Xaa is Gln or Ser
  SITE (386)..(386): Xaa is Tyr or Val
  SITE (388)..(388): Xaa is Gln or Ser
  SITE (393)..(393): Xaa is Gln or Ser
  SITE (394)..(394): Xaa is Tyr or Val
  SITE (396)..(396): Xaa is Gln or Ser
  SITE (401)..(401): Xaa is Gln or Ser
  SITE (402)..(402): Xaa is Tyr or Val
  SITE (404)..(404): Xaa is Gln or Ser
  SITE (409)..(409): Xaa is Gln or Ser
  SITE (410)..(410): Xaa is Tyr or Val
  SITE (412)..(412): Xaa is Gln or Ser
  SITE (417)..(417): Xaa is Gln or Ser
  SITE (418)..(418): Xaa is Tyr or Val
  SITE (420)..(420): Xaa is Gln or Ser
  SITE (425)..(425): Xaa is Gln or Ser
  SITE (426)..(426): Xaa is Tyr or Val
  SITE (428)..(428): Xaa is Gln or Ser
  SITE (433)..(433): Xaa is Gln or Ser
  SITE (434)..(434): Xaa is Tyr or Val
  SITE (436)..(436): Xaa is Gln or Ser
  SITE (441)..(441): Xaa is Gln or Ser
  SITE (442)..(442): Xaa is Tyr or Val
  SITE (444)..(444): Xaa is Gln or Ser
  SITE (449)..(449): Xaa is Gln or Ser
  SITE (450)..(450): Xaa is Tyr or Val
  SITE (452)..(452): Xaa is Gln or Ser
  SITE (457)..(457): Xaa is Gln or Ser
  SITE (458)..(458): Xaa is Tyr or Val
  SITE (460)..(460): Xaa is Gln or Ser
  SITE (465)..(465): Xaa is Gln or Ser
  SITE (466)..(466): Xaa is Tyr or Val
  SITE (468)..(468): Xaa is Gln or Ser
  SITE (473)..(473): Xaa is Gln or Ser
  SITE (474)..(474): Xaa is Tyr or Val
  SITE (476)..(476): Xaa is Gln or Ser
  SITE (481)..(481): Xaa is Gln or Ser
  SITE (482)..(482): Xaa is Tyr or Val
  SITE (484)..(484): Xaa is Gln or Ser
  SITE (489)..(489): Xaa is Gln or Ser
  SITE (490)..(490): Xaa is Tyr or Val
  SITE (492)..(492): Xaa is Gln or Ser
  SITE (497)..(497): Xaa is Gln or Ser
  SITE (498)..(498): Xaa is Tyr or Val
  SITE (500)..(500): Xaa is Gln or Ser
  SITE (505)..(505): Xaa is Gln or Ser
  SITE (506)..(506): Xaa is Tyr or Val
  SITE (508)..(508): Xaa is Gln or Ser
  SITE (513)..(513): Xaa is Gln or Ser
  SITE (514)..(514): Xaa is Tyr or Val
  SITE (516)..(516): Xaa is Gln or Ser
  SITE (521)..(521): Xaa is Gln or Ser
  SITE (522)..(522): Xaa is Tyr or Val
  SITE (524)..(524): Xaa is Gln or Ser
  SITE (529)..(529): Xaa is Gln or Ser
  SITE (530)..(530): Xaa is Tyr or Val
  SITE (532)..(532): Xaa is Gln or Ser
  SITE (537)..(537): Xaa is Gln or Ser
  SITE (538)..(538): Xaa is Tyr or Val
  SITE (540)..(540): Xaa is Gln or Ser
  SITE (545)..(545): Xaa is Gln or Ser
  SITE (546)..(546): Xaa is Tyr or Val
  SITE (548)..(548): Xaa is Gln or Ser
  SITE (553)..(553): Xaa is Gln or Ser
  SITE (554)..(554): Xaa is Tyr or Val
  SITE (556)..(556): Xaa is Gln or Ser
  SITE (561)..(561): Xaa is Gln or Ser
  SITE (562)..(562): Xaa is Tyr or Val
  SITE (564)..(564): Xaa is Gln or Ser
  SITE (569)..(569): Xaa is Gln or Ser
  SITE (570)..(570): Xaa is Tyr or Val
  SITE (572)..(572): Xaa is Gln or Ser
  SITE (577)..(577): Xaa is Gln or Ser
  SITE (578)..(578): Xaa is Tyr or Val
  SITE (580)..(580): Xaa is Gln or Ser
  SITE (585)..(585): Xaa is Gln or Ser
  SITE (586)..(586): Xaa is Tyr or Val
  SITE (588)..(588): Xaa is Gln or Ser
  SITE (593)..(593): Xaa is Gln or Ser
  SITE (594)..(594): Xaa is Tyr or Val
  SITE (596)..(596): Xaa is Gln or Ser
  SITE (601)..(601): Xaa is Gln or Ser
  SITE (602)..(602): Xaa is Tyr or Val
  SITE (604)..(604): Xaa is Gln or Ser
  SITE (609)..(609): Xaa is Gln or Ser
  SITE (610)..(610): Xaa is Tyr or Val
  SITE (612)..(612): Xaa is Gln or Ser
  SITE (617)..(617): Xaa is Gln or Ser
  SITE (618)..(618): Xaa is Tyr or Val
  SITE (620)..(620): Xaa is Gln or Ser
  SITE (625)..(625): Xaa is Gln or Ser
  SITE (626)..(626): Xaa is Tyr or Val
  SITE (628)..(628): Xaa is Gln or Ser
  SITE (633)..(633): Xaa is Gln or Ser
  SITE (634)..(634): Xaa is Tyr or Val
  SITE (636)..(636): Xaa is Gln or Ser
  SITE (641)..(641): Xaa is Gln or Ser
  SITE (642)..(642): Xaa is Tyr or Val
  SITE (644)..(644): Xaa is Gln or Ser
  SITE (649)..(649): Xaa is Gln or Ser
  SITE (650)..(650): Xaa is Tyr or Val
  SITE (652)..(652): Xaa is Gln or Ser
  SITE (657)..(657): Xaa is Gln or Ser
  SITE (658)..(658): Xaa is Tyr or Val
  SITE (660)..(660): Xaa is Gln or Ser
  SITE (665)..(665): Xaa is Gln or Ser
  SITE (666)..(666): Xaa is Tyr or Val
  SITE (668)..(668): Xaa is Gln or Ser
  SITE (673)..(673): Xaa is Gln or Ser
  SITE (674)..(674): Xaa is Tyr or Val
  SITE (676)..(676): Xaa is Gln or Ser
  SITE (681)..(681): Xaa is Gln or Ser
  SITE (682)..(682): Xaa is Tyr or Val
  SITE (684)..(684): Xaa is Gln or Ser
  SITE (689)..(689): Xaa is Gln or Ser
  SITE (690)..(690): Xaa is Tyr or Val
  SITE (692)..(692): Xaa is Gln or Ser
  SITE (697)..(697): Xaa is Gln or Ser
  SITE (698)..(698): Xaa is Tyr or Val
  SITE (700)..(700): Xaa is Gln or Ser
  SITE (705)..(705): Xaa is Gln or Ser
  SITE (706)..(706): Xaa is Tyr or Val
  SITE (708)..(708): Xaa is Gln or Ser
  SITE (713)..(713): Xaa is Gln or Ser
  SITE (714)..(714): Xaa is Tyr or Val
  SITE (716)..(716): Xaa is Gln or Ser
  SITE (721)..(721): Xaa is Gln or Ser
  SITE (722)..(722): Xaa is Tyr or Val
  SITE (724)..(724): Xaa is Gln or Ser
  SITE (729)..(729): Xaa is Gln or Ser
  SITE (730)..(730): Xaa is Tyr or Val
  SITE (732)..(732): Xaa is Gln or Ser
  SITE (737)..(737): Xaa is Gln or Ser
  SITE (738)..(738): Xaa is Tyr or Val
  SITE (740)..(740): Xaa is Gln or Ser
  SITE (745)..(745): Xaa is Gln or Ser
  SITE (746)..(746): Xaa is Tyr or Val
  SITE (748)..(748): Xaa is Gln or Ser
  SITE (753)..(753): Xaa is Gln or Ser
  SITE (754)..(754): Xaa is Tyr or Val
  SITE (756)..(756): Xaa is Gln or Ser
  SITE (761)..(761): Xaa is Gln or Ser
  SITE (762)..(762): Xaa is Tyr or Val
  SITE (764)..(764): Xaa is Gln or Ser
  SITE (769)..(769): Xaa is Gln or Ser
  SITE (770)..(770): Xaa is Tyr or Val
  SITE (772)..(772): Xaa is Gln or Ser
  SITE (777)..(777): Xaa is Gln or Ser
  SITE (778)..(778): Xaa is Tyr or Val
  SITE (780)..(780): Xaa is Gln or Ser
  SITE (785)..(785): Xaa is Gln or Ser
  SITE (786)..(786): Xaa is Tyr or Val
  SITE (788)..(788): Xaa is Gln or Ser
  SITE (793)..(793): Xaa is Gln or Ser
  SITE (794)..(794): Xaa is Tyr or Val
  SITE (796)..(796): Xaa is Gln or Ser
  SITE (801)..(801): Xaa is Gln or Ser
  SITE (802)..(802): Xaa is Tyr or Val
  SITE (804)..(804): Xaa is Gln or Ser
  SITE (809)..(809): Xaa is Gln or Ser
  SITE (810)..(810): Xaa is Tyr or Val
  SITE (812)..(812): Xaa is Gln or Ser
  SITE (817)..(817): Xaa is Gln or Ser
  SITE (818)..(818): Xaa is Tyr or Val
  SITE (820)..(820): Xaa is Gln or Ser
  SITE (825)..(825): Xaa is Gln or Ser
  SITE (826)..(826): Xaa is Tyr or Val
  SITE (828)..(828): Xaa is Gln or Ser
  SITE (833)..(833): Xaa is Gln or Ser
  SITE (834)..(834): Xaa is Tyr or Val
  SITE (836)..(836): Xaa is Gln or Ser
  SITE (841)..(841): Xaa is Gln or Ser
  SITE (842)..(842): Xaa is Tyr or Val
  SITE (844)..(844): Xaa is Gln or Ser
  SITE (849)..(849): Xaa is Gln or Ser
  SITE (850)..(850): Xaa is Tyr or Val
  SITE (852)..(852): Xaa is Gln or Ser
  SITE (857)..(857): Xaa is Gln or Ser
  SITE (858)..(858): Xaa is Tyr or Val
  SITE (860)..(860): Xaa is Gln or Ser
  SITE (865)..(865): Xaa is Gln or Ser
  SITE (866)..(866): Xaa is Tyr or Val
  SITE (868)..(868): Xaa is Gln or Ser
  SITE (873)..(873): Xaa is Gln or Ser
  SITE (874)..(874): Xaa is Tyr or Val
  SITE (876)..(876): Xaa is Gln or Ser
  SITE (881)..(881): Xaa is Gln or Ser
  SITE (882)..(882): Xaa is Tyr or Val
  SITE (884)..(884): Xaa is Gln or Ser
  SITE (889)..(889): Xaa is Gln or Ser
  SITE (890)..(890): Xaa is Tyr or Val
  SITE (892)..(892): Xaa is Gln or Ser
  SITE (897)..(897): Xaa is Gln or Ser
  SITE (898)..(898): Xaa is Tyr or Val
  SITE (900)..(900): Xaa is Gln or Ser
  SITE (905)..(905): Xaa is Gln or Ser
  SITE (906)..(906): Xaa is Tyr or Val
  SITE (908)..(908): Xaa is Gln or Ser
  SITE (913)..(913): Xaa is Gln or Ser
  SITE (914)..(914): Xaa is Tyr or Val
  SITE (916)..(916): Xaa is Gln or Ser
  SITE (921)..(921): Xaa is Gln or Ser
  SITE (922)..(922): Xaa is Tyr or Val
  SITE (924)..(924): Xaa is Gln or Ser
  SITE (929)..(929): Xaa is Gln or Ser
  SITE (930)..(930): Xaa is Tyr or Val
  SITE (932)..(932): Xaa is Gln or Ser
  SITE (937)..(937): Xaa is Gln or Ser
  SITE (938)..(938): Xaa is Tyr or Val
  SITE (940)..(940): Xaa is Gln or Ser
  SITE (945)..(945): Xaa is Gln or Ser
  SITE (946)..(946): Xaa is Tyr or Val
  SITE (948)..(948): Xaa is Gln or Ser
  SITE (953)..(953): Xaa is Gln or Ser
  SITE (954)..(954): Xaa is Tyr or Val
  SITE (956)..(956): Xaa is Gln or Ser
  SITE (961)..(961): Xaa is Gln or Ser
  SITE (962)..(962): Xaa is Tyr or Val
  SITE (964)..(964): Xaa is Gln or Ser
  SITE (969)..(969): Xaa is Gln or Ser
  SITE (970)..(970): Xaa is Tyr or Val
  SITE (972)..(972): Xaa is Gln or Ser
  SITE (977)..(977): Xaa is Gln or Ser
  SITE (978)..(978): Xaa is Tyr or Val
  SITE (980)..(980): Xaa is Gln or Ser
  SITE (985)..(985): Xaa is Gln or Ser
  SITE (986)..(986): Xaa is Tyr or Val
  SITE (988)..(988): Xaa is Gln or Ser
  SITE (993)..(993): Xaa is Gln or Ser
  SITE (994)..(994): Xaa is Tyr or Val
  SITE (996)..(996): Xaa is Gln or Ser
  SITE (1001)..(1001): Xaa is Gln or Ser
  SITE (1002)..(1002): Xaa is Tyr or Val
  SITE (1004)..(1004): Xaa is Gln or Ser
  SITE (1009)..(1009): Xaa is Gln or Ser
  SITE (1010)..(1010): Xaa is Tyr or Val
  SITE (1012)..(1012): Xaa is Gln or Ser
  SITE (1017)..(1017): Xaa is Gln or Ser
  SITE (1018)..(1018): Xaa is Tyr or Val
  SITE (1020)..(1020): Xaa is Gln or Ser
  SITE (1025)..(1025): Xaa is Gln or Ser
  SITE (1026)..(1026): Xaa is Tyr or Val
  SITE (1028)..(1028): Xaa is Gln or Ser
  SITE (1033)..(1033): Xaa is Gln or Ser
  SITE (1034)..(1034): Xaa is Tyr or Val
  SITE (1036)..(1036): Xaa is Gln or Ser
  SITE (1041)..(1041): Xaa is Gln or Ser
  SITE (1042)..(1042): Xaa is Tyr or Val
  SITE (1044)..(1044): Xaa is Gln or Ser
  SITE (1049)..(1049): Xaa is Gln or Ser
  SITE (1050)..(1050): Xaa is Tyr or Val
  SITE (1052)..(1052): Xaa is Gln or Ser
  SITE (1057)..(1057): Xaa is Gln or Ser
  SITE (1058)..(1058): Xaa is Tyr or Val
  SITE (1060)..(1060): Xaa is Gln or Ser
  SITE (1065)..(1065): Xaa is Gln or Ser
  SITE (1066)..(1066): Xaa is Tyr or Val
  SITE (1068)..(1068): Xaa is Gln or Ser
  SITE (1073)..(1073): Xaa is Gln or Ser
  SITE (1074)..(1074): Xaa is Tyr or Val
  SITE (1076)..(1076): Xaa is Gln or Ser
  SITE (1081)..(1081): Xaa is Gln or Ser
  SITE (1082)..(1082): Xaa is Tyr or Val
  SITE (1084)..(1084): Xaa is Gln or Ser
  SITE (1089)..(1089): Xaa is Gln or Ser
  SITE (1090)..(1090): Xaa is Tyr or Val
  SITE (1092)..(1092): Xaa is Gln or Ser
  SITE (1097)..(1097): Xaa is Gln or Ser
  SITE (1098)..(1098): Xaa is Tyr or Val
  SITE (1100)..(1100): Xaa is Gln or Ser
  SITE (1105)..(1105): Xaa is Gln or Ser
  SITE (1106)..(1106): Xaa is Tyr or Val
  SITE (1108)..(1108): Xaa is Gln or Ser
  SITE (1113)..(1113): Xaa is Gln or Ser
  SITE (1114)..(1114): Xaa is Tyr or Val
  SITE (1116)..(1116): Xaa is Gln or Ser
  SITE (1121)..(1121): Xaa is Gln or Ser
  SITE (1122)..(1122): Xaa is Tyr or Val
  SITE (1124)..(1124): Xaa is Gln or Ser
  SITE (1129)..(1129): Xaa is Gln or Ser
  SITE (1130)..(1130): Xaa is Tyr or Val
  SITE (1132)..(1132): Xaa is Gln or Ser
  SITE (1137)..(1137): Xaa is Gln or Ser
  SITE (1138)..(1138): Xaa is Tyr or Val
  SITE (1140)..(1140): Xaa is Gln or Ser
  SITE (1145)..(1145): Xaa is Gln or Ser
  SITE (1146)..(1146): Xaa is Tyr or Val
  SITE (1148)..(1148): Xaa is Gln or Ser
  SITE (1153)..(1153): Xaa is Gln or Ser
  SITE (1154)..(1154): Xaa is Tyr or Val
  SITE (1156)..(1156): Xaa is Gln or Ser
  SITE (1161)..(1161): Xaa is Gln or Ser
  SITE (1162)..(1162): Xaa is Tyr or Val
  SITE (1164)..(1164): Xaa is Gln or Ser
  SITE (1169)..(1169): Xaa is Gln or Ser
  SITE (1170)..(1170): Xaa is Tyr or Val
  SITE (1172)..(1172): Xaa is Gln or Ser
  SITE (1177)..(1177): Xaa is Gln or Ser
  SITE (1178)..(1178): Xaa is Tyr or Val
  SITE (1180)..(1180): Xaa is Gln or Ser
  SITE (1185)..(1185): Xaa is Gln or Ser
  SITE (1186)..(1186): Xaa is Tyr or Val
  SITE (1188)..(1188): Xaa is Gln or Ser
  SITE (1193)..(1193): Xaa is Gln or Ser
  SITE (1194)..(1194): Xaa is Tyr or Val
  SITE (1196)..(1196): Xaa is Gln or Ser
  SITE (1201)..(1201): Xaa is Gln or Ser
  SITE (1202)..(1202): Xaa is Tyr or Val
  SITE (1204)..(1204): Xaa is Gln or Ser
  SITE (1209)..(1209): Xaa is Gln or Ser
  SITE (1210)..(1210): Xaa is Tyr or Val
  SITE (1212)..(1212): Xaa is Gln or Ser
  SITE (1217)..(1217): Xaa is Gln or Ser
  SITE (1218)..(1218): Xaa is Tyr or Val
  SITE (1220)..(1220): Xaa is Gln or Ser
  SITE (1225)..(1225): Xaa is Gln or Ser
  SITE (1226)..(1226): Xaa is Tyr or Val
  SITE (1228)..(1228): Xaa is Gln or Ser
  SITE (1233)..(1233): Xaa is Gln or Ser
  SITE (1234)..(1234): Xaa is Tyr or Val
  SITE (1236)..(1236): Xaa is Gln or Ser
  SITE (1241)..(1241): Xaa is Gln or Ser
  SITE (1242)..(1242): Xaa is Tyr or Val
  SITE (1244)..(1244): Xaa is Gln or Ser
  SITE (1249)..(1249): Xaa is Gln or Ser
  SITE (1250)..(1250): Xaa is Tyr or Val
  SITE (1252)..(1252): Xaa is Gln or Ser
  SITE (1257)..(1257): Xaa is Gln or Ser
  SITE (1258)..(1258): Xaa is Tyr or Val
  SITE (1260)..(1260): Xaa is Gln or Ser
  SITE (1265)..(1265): Xaa is Gln or Ser
  SITE (1266)..(1266): Xaa is Tyr or Val
  SITE (1268)..(1268): Xaa is Gln or Ser
  SITE (1273)..(1273): Xaa is Gln or Ser
  SITE (1274)..(1274): Xaa is Tyr or Val
  SITE (1276)..(1276): Xaa is Gln or Ser
XXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRGXXPXDGRG

SEQ ID NO: 52 - protein, 800 aa, Artificial Sequence
  elastin-like polypeptide
  SITE (51)..(800): May be present or absent in groups of the repeat unit Gly Val Gly Val Pro
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 53 - protein, 800 aa, Artificial Sequence
  elastin-like polypeptide
  SITE (51)..(800): May be present or absent in groups of the repeat unit Gly Val Gly Val Pro Gly Val Gly Val Pro Gly Ala Gly Val Pro Gly Val Gly Val Pro Gly Val Gly Val Pro
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 54 - protein, 800 aa, Artificial Sequence
  elastin-like polypeptide
  SITE (51)..(800): May be present or absent in groups of the repeat unit Gly Val Gly Val Pro Gly Ala Gly Val Pro
GVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVPGVGVPGAGVP

SEQ ID NO: 55 - protein, 800 aa, Artificial Sequence
  elastin-like polypeptide
  SITE (51)..(800): May be present or absent in groups of the repeat unit Gly Val Gly Val Pro Gly Val Gly Val Pro Gly Leu Gly Val Pro Gly Val Gly Val Pro Gly Val Gly Val Pro
GVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVPGVGVPGVGVPGLGVPGVGVPGVGVP

SEQ ID NO: 56 - protein, 800 aa, Artificial Sequence
  elastin-like polypeptide
  SITE (2)..(2): Xaa can be Gly, Ala, Val, Ile, Leu, Phe, Tyr, Trp, Lys, Arg, Asp, Glu or Ser
  SITE (7)..(7): Xaa can be Gly, Ala, Val, Ile, Leu, Phe, Tyr, Trp, Lys, Arg, Asp, Glu or Ser
  SITE (12)..(12): Xaa can be Gly, Ala, Val, Ile, Leu, Phe, Tyr, Trp, Lys, Arg, Asp, Glu or Ser
  SITE (17)..(17): Xaa can be Gly, Ala, Val, Ile, Leu, Phe, Tyr, Trp, Lys, Arg, Asp, Glu or Ser
  SITE (22)..(22): Xaa can be Gly, Ala, Val, Ile, Leu, Phe, Tyr, Trp, Lys, Arg, Asp, Glu or Ser
  SITE (27)..(27): Xaa can be Gly, Ala, Val, Ile, Leu, Phe, Tyr, Trp, Lys, Arg, Asp, Glu or Ser
  SITE (32)..(32): Xaa can be Gly, Ala, Val, Ile, Leu, Phe, Tyr, Trp, Lys, Arg, Asp, Glu or Ser
  SITE (37)..(37): Xaa can be Gly, Ala, Val, Ile, Leu, Phe, Tyr, Trp, Lys, Arg, Asp, Glu or Ser
  SITE (42)..(42): Xaa can be Gly, Ala, Val, Ile, Leu, Phe, Tyr, Trp, Lys, Arg, Asp, Glu or Ser
  SITE (47)..(47): Xaa can be Gly, Ala, Val, Ile, Leu, Phe, Tyr, Trp, Lys, Arg, Asp, Glu or Ser
  SITE (51)..(800): May be present or absent in groups of the repeat unit Gly Xaa Gly Val Pro
  SITE (52)..(52): Xaa can be Gly, Ala, Val, Ile, Leu, Phe, Tyr, Trp, Lys, Arg, Asp, Glu or Ser
  SITE (57)..(57): Xaa can be Gly, Ala, Val, Ile, Leu, Phe, Tyr, Trp, Lys, Arg, Asp, Glu or Ser
  SITE (62)..(62): Xaa can be Gly, Ala, Val, Ile, Leu, Phe, Tyr, Trp, Lys, Arg, Asp, Glu or Ser
  SITE (67)..(67): Xaa can be Gly, Ala, Val, Ile, Leu, Phe, Tyr, Trp, Lys, Arg, Asp, Glu or Ser
  SITE (72)..(72): Xaa can be Gly, Ala, Val, Ile, Leu, Phe, Tyr, Trp, Lys, Arg, Asp, Glu or Ser
  SITE (77)..(77): Xaa can be Gly, Ala, Val, Ile, Leu, Phe, Tyr, Trp, Lys, Arg, Asp, Glu or Ser
  SITE (82)..(82): Xaa can be Gly, Ala, Val, Ile, Leu, Phe, Tyr, Trp, Lys, Arg, Asp, Glu or Ser
  SITE (87)..(87): Xaa can be Gly, Ala, Val, Ile, Leu, Phe, Tyr, Trp, Lys, Arg, Asp, Glu or Ser
  SITE (92)..(92): Xaa can be Gly, Ala, Val, Ile, Leu, Phe, Tyr, Trp, Lys, Arg, Asp, Glu or Ser
  SITE (97)..(97): Xaa can be Gly, Ala, Val, Ile, Leu, Phe, Tyr, Trp, Lys, Arg, Asp, Glu or Ser
  SITE (102)..(102): Xaa can be Gly, Ala, Val, Ile, Leu, Phe, Tyr, Trp, Lys, Arg, Asp, Glu or Ser
  SITE (107)..(107): Xaa can be Gly, Ala, Val, Ile, Leu, Phe, Tyr, Trp, Lys, Arg, Asp, Glu or Ser
  SITE (112)..(112): Xaa can be Gly, Ala, Val, Ile, Leu, Phe, Tyr, Trp, Lys, Arg, Asp, Glu or Ser
  SITE (117)..(117): Xaa can be Gly, Ala, Val, Ile, Leu, Phe, Tyr, Trp, Lys, Arg, Asp, Glu or Ser
  SITE (122)..(122): Xaa can be Gly, Ala, Val, Ile, Leu, Phe, Tyr, Trp, Lys, Arg, Asp, Glu or Ser
  SITE (127)..(127): Xaa can be Gly, Ala, Val, Ile, Leu, Phe, Tyr, Trp, Lys, Arg, Asp, Glu or Ser
  SITE (132)..(132): Xaa can be Gly, Ala, Val, Ile, Leu, Phe, Tyr, Trp, Lys, Arg, Asp, Glu or Ser
  SITE (137)..(137): Xaa can be Gly, Ala, Val, Ile, Leu, Phe, Tyr, Trp, Lys, Arg, Asp, Glu or Ser
  SITE (142)..(142): Xaa can be Gly, Ala, Val, Ile, Leu, Phe, Tyr, Trp, Lys, Arg, Asp, Glu or Ser
  SITE (147)..(147): Xaa can be Gly, Ala, Val, Ile, Leu, Phe, Tyr, Trp, Lys, Arg, Asp, Glu or Ser
  SITE (152)..(152): Xaa can be Gly, Ala, Val, Ile, Leu, Phe, Tyr, Trp, Lys, Arg, Asp, Glu or Ser
  SITE (157)..(157): Xaa can be Gly, Ala, Val, Ile, Leu, Phe, Tyr, Trp, Lys, Arg, Asp, Glu or Ser
  SITE (162)..(162): Xaa can be Gly, Ala, Val, Ile, Leu, Phe, Tyr, Trp, Lys, Arg, Asp, Glu or Ser
  SITE (167)..(167): Xaa can be Gly, Ala, Val, Ile, Leu, Phe, Tyr, Trp, Lys, Arg, Asp, Glu or Ser
  SITE (172)..(172): Xaa can be Gly, Ala, Val, Ile, Leu, Phe, Tyr, Trp, Lys, Arg, Asp, Glu or Ser
  SITE (177)..(177): Xaa can be Gly, Ala, Val, Ile, Leu, Phe, Tyr, Trp, Lys, Arg, Asp, Glu or Ser
  SITE (182)..(182): Xaa can be Gly, Ala, Val, Ile, Leu, Phe, Tyr, Trp, Lys, Arg, Asp, Glu or Ser
  SITE (187)..(187): Xaa can be Gly, Ala, Val, Ile, Leu, Phe, Tyr, Trp, Lys, Arg, Asp, Glu or Ser
  SITE (192)..(192): Xaa can be Gly, Ala, Val, Ile, Leu, Phe, Tyr, Trp, Lys, Arg, Asp, Glu or Ser
  SITE (197)..(197): Xaa can be Gly, Ala, Val, Ile, Leu, Phe, Tyr, Trp, Lys, Arg, Asp, Glu or Ser
  SITE (202)..(202): Xaa can be Gly, Ala, Val, Ile, Leu, Phe, Tyr, Trp, Lys, Arg, Asp, Glu or Ser
  SITE (207)..(207): Xaa can be Gly, Ala, Val, Ile, Leu, Phe, Tyr, Trp, Lys, Arg, Asp, Glu or Ser
  SITE (212)..(212): Xaa can be Gly, Ala, Val, Ile, Leu, Phe, Tyr, Trp, Lys, Arg, Asp, Glu or Ser
  SITE (217)..(217): Xaa can be Gly, Ala, Val, Ile, Leu, Phe, Tyr, Trp, Lys, Arg, Asp, Glu or Ser
  SITE (222)..(222): Xaa can be Gly, Ala, Val, Ile, Leu, Phe, Tyr, Trp, Lys, Arg, Asp, Glu or Ser
  SITE (227)..(227): Xaa can be Gly, Ala, Val, Ile, Leu, Phe, Tyr, Trp, Lys, Arg, Asp, Glu or Ser
  SITE (232)..(232): Xaa can be Gly, Ala, Val, Ile, Leu, Phe, Tyr, Trp, Lys, Arg, Asp, Glu or Ser
  SITE (237)..(237): Xaa can be Gly, Ala, Val, Ile, Leu, Phe, Tyr, Trp, Lys, Arg, Asp, Glu or Ser
  SITE (242)..(242): Xaa can be Gly, Ala, Val, Ile, Leu, Phe, Tyr, Trp, Lys, Arg, Asp, Glu or Ser
  SITE (247)..(247): Xaa can be Gly, Ala, Val, Ile, Leu, Phe, Tyr, Trp, Lys, Arg, Asp, Glu or Ser
  SITE (252)..(252): Xaa can be Gly, Ala, Val, Ile, Leu, Phe, Tyr, Trp, Lys, Arg, Asp, Glu or Ser
  SITE (257)..(257): Xaa can be Gly, Ala, Val, Ile, Leu, Phe, Tyr, Trp, Lys, Arg, Asp, Glu or Ser
  SITE (262)..(262): Xaa can be Gly, Ala, Val, Ile, Leu, Phe, Tyr, Trp, Lys, Arg, Asp, Glu or Ser
  SITE (267)..(267): Xaa can be Gly, Ala, Val, Ile, Leu, Phe, Tyr, Trp, Lys, Arg, Asp, Glu or Ser
  SITE (272)..(272): Xaa can be Gly, Ala, Val, Ile, Leu, Phe, Tyr, Trp, Lys, Arg, Asp, Glu or Ser
  SITE (277)..(277): Xaa can be Gly, Ala, Val, Ile, Leu, Phe, Tyr, Trp, Lys, Arg, Asp, Glu or Ser
  SITE (282)..(282): Xaa can be Gly, Ala, Val, Ile, Leu, Phe, Tyr, Trp, Lys, Arg, Asp, Glu or Ser
  SITE (287)..(287): Xaa can be Gly, Ala, Val, Ile, Leu, Phe, Tyr, Trp, Lys, Arg, Asp, Glu or Ser
  SITE (292)..(292): Xaa can be Gly, Ala, Val, Ile, Leu, Phe, Tyr, Trp, Lys, Arg, Asp, Glu or Ser
  SITE (297)..(297): Xaa can be Gly, Ala, Val, Ile, Leu, Phe, Tyr, Trp, Lys, Arg, Asp, Glu or Ser
  SITE (302)..(302): Xaa can be Gly, Ala, Val, Ile, Leu, Phe, Tyr, Trp, Lys, Arg, Asp, Glu or Ser
  SITE (307)..(307): Xaa can be Gly, Ala, Val, Ile, Leu, Phe, Tyr, Trp, Lys, Arg, Asp, Glu or Ser
  SITE (312)..(312): Xaa can be Gly, Ala, Val, Ile, Leu, Phe, Tyr, Trp, Lys, Arg, Asp, Glu or Ser
  SITE (317)..(317): Xaa can be Gly, Ala, Val, Ile, Leu, Phe, Tyr, Trp, Lys, Arg, Asp, Glu or Ser
  SITE (322)..(322): Xaa can be Gly, Ala, Val, Ile, Leu, Phe, Tyr, Trp, Lys, Arg, Asp, Glu or Ser
  SITE (327)..(327): Xaa can be Gly, Ala, Val, Ile, Leu, Phe, Tyr, Trp, Lys, Arg, Asp, Glu or Ser
  SITE (332)..(332): Xaa can be Gly, Ala, Val, Ile, Leu, Phe, Tyr, Trp, Lys, Arg, Asp, Glu or Ser
  SITE (337)..(337): Xaa can be Gly, Ala, Val, Ile, Leu, Phe, Tyr, Trp, Lys, Arg, Asp, Glu or Ser
  SITE (342)..(342): Xaa can be Gly, Ala, Val, Ile, Leu, Phe, Tyr, Trp, Lys, Arg, Asp, Glu or Ser
  SITE (347)..(347): Xaa can be Gly, Ala, Val, Ile, Leu, Phe, Tyr, Trp, Lys, Arg, Asp, Glu or Ser
  SITE (352)..(352): Xaa can be Gly, Ala, Val, Ile, Leu, Phe, Tyr, Trp, Lys, Arg, Asp, Glu or Ser
  SITE (357)..(357): Xaa can be Gly, Ala, Val, Ile, Leu, Phe, Tyr, Trp, Lys, Arg, Asp, Glu or Ser
  SITE (362)..(362): Xaa can be Gly, Ala, Val, Ile, Leu, Phe, Tyr, Trp, Lys, Arg, Asp, Glu or Ser
  SITE (367)..(367): Xaa can be Gly, Ala, Val, Ile, Leu, Phe, Tyr, Trp, Lys, Arg, Asp, Glu or Ser
  SITE (372)..(372): Xaa can be Gly, Ala, Val, Ile, Leu, Phe, Tyr, Trp, Lys, Arg, Asp, Glu or Ser
  SITE (377)..(377): Xaa can be Gly, Ala, Val, Ile, Leu, Phe, Tyr, Trp, Lys, Arg, Asp, Glu or Ser
  SITE (382)..(382): Xaa can be Gly, Ala, Val, Ile, Leu, Phe, Tyr, Trp, Lys, Arg, Asp, Glu or Ser
  SITE (387)..(387): Xaa can be Gly, Ala, Val, Ile, Leu, Phe, Tyr, Trp, Lys, Arg, Asp, Glu or Ser
  SITE (392)..(392): Xaa can be Gly, Ala, Val, Ile, Leu, Phe, Tyr, Trp, Lys, Arg, Asp, Glu or Ser
  SITE (397)..(397): Xaa can be Gly, Ala, Val, Ile, Leu, Phe, Tyr, Trp, Lys, Arg, Asp, Glu or Ser
  SITE (402)..(402): Xaa can be Gly, Ala, Val, Ile, Leu, Phe, Tyr, Trp, Lys, Arg, Asp, Glu or Ser
  SITE (407)..(407): Xaa can be Gly, Ala, Val, Ile, Leu, Phe, Tyr, Trp, Lys, Arg, Asp, Glu or Ser
  SITE (412)..(412): Xaa can be Gly, Ala, Val, Ile, Leu, Phe, Tyr, Trp, Lys, Arg, Asp, Glu or Ser
  SITE (417)..(417): Xaa can be Gly, Ala, Val, Ile, Leu, Phe, Tyr, Trp, Lys, Arg, Asp, Glu or Ser
  SITE (422)..(422): Xaa can be Gly, Ala, Val, Ile, Leu, Phe, Tyr, Trp, Lys, Arg, Asp, Glu or Ser
  SITE (427)..(427): Xaa can be Gly, Ala, Val, Ile, Leu, Phe, Tyr, Trp, Lys, Arg, Asp, Glu or Ser
  SITE (432)..(432): Xaa can be Gly, Ala, Val, Ile, Leu, Phe, Tyr, Trp, Lys, Arg, Asp, Glu or Ser
  SITE (437)..(437): Xaa can be Gly, Ala, Val, Ile, Leu, Phe, Tyr, Trp, Lys, Arg, Asp, Glu or Ser
  SITE (442)..(442): Xaa can be Gly, Ala, Val, Ile, Leu, Phe, Tyr, Trp, Lys, Arg, Asp, Glu or Ser
  SITE (447)..(447): Xaa can be Gly, Ala, Val, Ile, Leu, Phe, Tyr, Trp, Lys, Arg, Asp, Glu or Ser
  SITE (452)..(452): Xaa can be Gly, Ala, Val, Ile, Leu, Phe, Tyr, Trp, Lys, Arg, Asp, Glu or Ser
  SITE (457)..(457): Xaa can be Gly, Ala, Val, Ile, Leu, Phe, Tyr, Trp, Lys, Arg, Asp, Glu or Ser
  SITE (462)..(462): Xaa can be Gly, Ala, Val, Ile, Leu, Phe, Tyr, Trp, Lys, Arg, Asp, Glu or Ser
  SITE (467)..(467): Xaa can be Gly, Ala, Val, Ile, Leu, Phe, Tyr, Trp, Lys, Arg, Asp, Glu or Ser
  SITE (472)..(472): Xaa can be Gly, Ala, Val, Ile, Leu, Phe, Tyr, Trp, Lys, Arg, Asp, Glu or Ser
  SITE (477)..(477): Xaa can be Gly, Ala, Val, Ile, Leu, Phe, Tyr, Trp, Lys, Arg, Asp, Glu or Ser
  SITE (482)..(482): Xaa can be Gly, Ala, Val, Ile, Leu, Phe, Tyr, Trp, Lys, Arg, Asp, Glu or Ser
  SITE (487)..(487): Xaa can be Gly, Ala, Val, Ile, Leu, Phe, Tyr, Trp, Lys, Arg, Asp, Glu or Ser
  SITE (492)..(492): Xaa can be Gly, Ala, Val, Ile, Leu, Phe, Tyr, Trp, Lys, Arg, Asp, Glu or Ser
  SITE (497)..(497): Xaa can be Gly, Ala, Val, Ile, Leu, Phe, Tyr, Trp, Lys, Arg, Asp, Glu or Ser
  SITE (502)..(502): Xaa can be Gly, Ala, Val, Ile, Leu, Phe, Tyr, Trp, Lys, Arg, Asp, Glu or Ser
  SITE (507)..(507): Xaa can be Gly, Ala, Val, Ile, Leu, Phe, Tyr, Trp, Lys, Arg, Asp, Glu or Ser
  SITE (512)..(512): Xaa can be Gly, Ala, Val, Ile, Leu, Phe, Tyr, Trp, Lys, Arg, Asp, Glu or Ser
  SITE (517)..(517): Xaa can be Gly, Ala, Val, Ile, Leu, Phe, Tyr, Trp, Lys, Arg, Asp, Glu or Ser
  SITE (522)..(522): Xaa can be Gly, Ala, Val, Ile, Leu, Phe, Tyr, Trp, Lys, Arg, Asp, Glu or Ser
  SITE (527)..(527): Xaa can be Gly, Ala, Val, Ile, Leu, Phe, Tyr, Trp, Lys, Arg, Asp, Glu or Ser
  SITE (532)..(532): Xaa can be Gly, Ala, Val, Ile, Leu, Phe, Tyr, Trp, Lys, Arg, Asp, Glu or Ser
  SITE (537)..(537): Xaa can be Gly, Ala, Val, Ile, Leu, Phe, Tyr, Trp, Lys, Arg, Asp, Glu or Ser
  SITE (542)..(542): Xaa can be Gly, Ala, Val, Ile, Leu, Phe, Tyr, Trp, Lys, Arg, Asp, Glu or Ser
  SITE (547)..(547): Xaa can be Gly, Ala, Val, Ile, Leu, Phe, Tyr, Trp, Lys, Arg, Asp, Glu or Ser
  SITE (552)..(552): Xaa can be Gly, Ala, Val, Ile, Leu, Phe, Tyr, Trp, Lys, Arg, Asp, Glu or Ser
  SITE (557)..(557): Xaa can be Gly, Ala, Val, Ile, Leu, Phe, Tyr, Trp, Lys, Arg, Asp, Glu or Ser
  SITE (562)..(562): Xaa can be Gly, Ala, Val, Ile, Leu, Phe, Tyr, Trp, Lys, Arg, Asp, Glu or Ser
  SITE (567)..(567): Xaa can be Gly, Ala, Val, Ile, Leu, Phe, Tyr, Trp, Lys, Arg, Asp, Glu or Ser
  SITE (572)..(572): Xaa can be Gly, Ala, Val, Ile, Leu, Phe, Tyr, Trp, Lys, Arg, Asp, Glu or Ser
  SITE (577)..(577): Xaa can be Gly, Ala, Val, Ile, Leu, Phe, Tyr, Trp, Lys, Arg, Asp, Glu or Ser
  SITE (582)..(582): Xaa can be Gly, Ala, Val, Ile, Leu, Phe, Tyr, Trp, Lys, Arg, Asp, Glu or Ser
  SITE (587)..(587): Xaa can be Gly, Ala, Val, Ile, Leu, Phe, Tyr, Trp, Lys, Arg, Asp, Glu or Ser
  SITE (592)..(592): Xaa can be Gly, Ala, Val, Ile, Leu, Phe, Tyr, Trp, Lys, Arg, Asp, Glu or Ser
  SITE (597)..(597): Xaa can be Gly, Ala, Val, Ile, Leu, Phe, Tyr, Trp, Lys, Arg, Asp, Glu or Ser
  SITE (602)..(602): Xaa can be Gly, Ala, Val, Ile, Leu, Phe, Tyr, Trp, Lys, Arg, Asp, Glu or Ser
  SITE (607)..(607): Xaa can be Gly, Ala, Val, Ile, Leu, Phe, Tyr, Trp, Lys, Arg, Asp, Glu or Ser
  SITE (612)..(612): Xaa can be Gly, Ala, Val, Ile, Leu, Phe, Tyr, Trp, Lys, Arg, Asp, Glu or Ser
  SITE (617)..(617): Xaa can be Gly, Ala, Val, Ile, Leu, Phe, Tyr, Trp, Lys, Arg, Asp, Glu or Ser
  SITE (622)..(622): Xaa can be Gly, Ala, Val, Ile, Leu, Phe, Tyr, Trp, Lys, Arg, Asp, Glu or Ser
  SITE (627)..(627): Xaa can be Gly, Ala, Val, Ile, Leu, Phe, Tyr, Trp, Lys, Arg, Asp, Glu or Ser
  SITE (632)..(632): Xaa can be Gly, Ala, Val, Ile, Leu, Phe, Tyr, Trp, Lys, Arg, Asp, Glu or Ser
  SITE (637)..(637): Xaa can be Gly, Ala, Val, Ile, Leu, Phe, Tyr, Trp, Lys, Arg, Asp, Glu or Ser
  SITE (642)..(642): Xaa can be Gly, Ala, Val, Ile, Leu, Phe, Tyr, Trp, Lys, Arg, Asp, Glu or Ser
  SITE (647)..(647): Xaa can be Gly, Ala, Val, Ile, Leu, Phe, Tyr, Trp, Lys, Arg, Asp, Glu or Ser
  SITE (652)..(652): Xaa can be Gly, Ala, Val, Ile, Leu, Phe, Tyr, Trp, Lys, Arg, Asp, Glu or Ser
  SITE (657)..(657): Xaa can be Gly, Ala, Val, Ile, Leu, Phe, Tyr, Trp, Lys, Arg, Asp, Glu or Ser
  SITE (662)..(662): Xaa can be Gly, Ala, Val, Ile, Leu, Phe, Tyr, Trp, Lys, Arg, Asp, Glu or Ser
  SITE (667)..(667): Xaa can be Gly, Ala, Val, Ile, Leu, Phe, Tyr, Trp, Lys, Arg, Asp, Glu or Ser
  SITE (672)..(672): Xaa can be Gly, Ala, Val, Ile, Leu, Phe, Tyr, Trp, Lys, Arg, Asp, Glu or Ser
  SITE (677)..(677): Xaa can be Gly, Ala, Val, Ile, Leu, Phe, Tyr, Trp, Lys, Arg, Asp, Glu or Ser
  SITE (682)..(682): Xaa can be Gly, Ala, Val, Ile, Leu, Phe, Tyr, Trp, Lys, Arg, Asp, Glu or Ser
  SITE (687)..(687): Xaa can be Gly, Ala, Val, Ile, Leu, Phe, Tyr, Trp, Lys, Arg, Asp, Glu or Ser
  SITE (692)..(692): Xaa can be Gly, Ala, Val, Ile, Leu, Phe, Tyr, Trp, Lys, Arg, Asp, Glu or Ser
  SITE (697)..(697): Xaa can be Gly, Ala, Val, Ile, Leu, Phe, Tyr, Trp, Lys, Arg, Asp, Glu or Ser
  SITE (702)..(702): Xaa can be Gly, Ala, Val, Ile, Leu, Phe, Tyr, Trp, Lys, Arg, Asp, Glu or Ser
  SITE (707)..(707): Xaa can be Gly, Ala, Val, Ile, Leu, Phe, Tyr, Trp, Lys, Arg, Asp, Glu or Ser
  SITE (712)..(712): Xaa can be Gly, Ala, Val, Ile, Leu, Phe, Tyr, Trp, Lys, Arg, Asp, Glu or Ser
  SITE (717)..(717): Xaa can be Gly, Ala, Val, Ile, Leu, Phe, Tyr, Trp, Lys, Arg, Asp, Glu or Ser
  SITE (722)..(722): Xaa can be Gly, Ala, Val, Ile, Leu, Phe, Tyr, Trp, Lys, Arg, Asp, Glu or Ser
  SITE (727)..(727): Xaa can be Gly, Ala, Val, Ile, Leu, Phe, Tyr, Trp, Lys, Arg, Asp, Glu or Ser
  SITE (732)..(732): Xaa can be Gly, Ala, Val, Ile, Leu, Phe, Tyr, Trp, Lys, Arg, Asp, Glu or Ser
  SITE (737)..(737): Xaa can be Gly, Ala, Val, Ile, Leu, Phe, Tyr, Trp, Lys, Arg, Asp, Glu or Ser
  SITE (742)..(742): Xaa can be Gly, Ala, Val, Ile, Leu, Phe, Tyr, Trp, Lys, Arg, Asp, Glu or Ser
  SITE (747)..(747): Xaa can be Gly, Ala, Val, Ile, Leu, Phe, Tyr, Trp, Lys, Arg, Asp, Glu or Ser
  SITE (752)..(752): Xaa can be Gly, Ala, Val, Ile, Leu, Phe, Tyr, Trp, Lys, Arg, Asp, Glu or Ser
  SITE (757)..(757): Xaa can be Gly, Ala, Val, Ile, Leu, Phe, Tyr, Trp, Lys, Arg, Asp, Glu or Ser
  SITE (762)..(762): Xaa can be Gly, Ala, Val, Ile, Leu, Phe, Tyr, Trp, Lys, Arg, Asp, Glu or Ser
  SITE (767)..(767): Xaa can be Gly, Ala, Val, Ile, Leu, Phe, Tyr, Trp, Lys, Arg, Asp, Glu or Ser
  SITE (772)..(772): Xaa can be Gly, Ala, Val, Ile, Leu, Phe, Tyr, Trp, Lys, Arg, Asp, Glu or Ser
  SITE (777)..(777): Xaa can be Gly, Ala, Val, Ile, Leu, Phe, Tyr, Trp, Lys, Arg, Asp, Glu or Ser
  SITE (782)..(782): Xaa can be Gly, Ala, Val, Ile, Leu, Phe, Tyr, Trp, Lys, Arg, Asp, Glu or Ser
  SITE (787)..(787): Xaa can be Gly, Ala, Val, Ile, Leu, Phe, Tyr, Trp, Lys, Arg, Asp, Glu or Ser
  SITE (792)..(792): Xaa can be Gly, Ala, Val, Ile, Leu, Phe, Tyr, Trp, Lys, Arg, Asp, Glu or Ser
  SITE (797)..(797): Xaa can be Gly, Ala, Val, Ile, Leu, Phe, Tyr, Trp, Lys, Arg, Asp, Glu or Ser
GXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVP

SEQ ID NO: 57 - protein, 1440 aa, Artificial Sequence
  elastin-like polypeptide
  SITE (1)..(1): Xaa can be any amino acid
  SITE (2)..(2): Xaa can be any amino acid
  SITE (4)..(4): Xaa can be any amino acid except Pro or Gly
  SITE (5)..(5): Xaa can be any amino acid except Pro or Gly
  SITE (6)..(6): Xaa can be any amino acid except Pro or Gly
  SITE (7)..(7): Xaa can be any amino acid except Pro or Gly
  SITE (9)..(9): Xaa can be any amino acid
  SITE (10)..(10): Xaa can be any amino acid
  SITE (11)..(11): Xaa can be any amino acid
  SITE (13)..(13): Xaa can be any amino acid except Pro or Gly
  SITE (14)..(14): Xaa can be any amino acid except Pro or Gly
  SITE (15)..(15): Xaa can be any amino acid except Pro or Gly
  SITE (16)..(16): Xaa can be any amino acid except Pro or Gly
  SITE (18)..(18): Xaa can be any amino acid
  SITE (19)..(19): Xaa can be any amino acid
  SITE (20)..(20): Xaa can be any amino acid
  SITE (22)..(22): Xaa can be any amino acid except Pro or Gly
  SITE (23)..(23): Xaa can be any amino acid except Pro or Gly
  SITE (24)..(24): Xaa can be any amino acid except Pro or Gly
  SITE (25)..(25): Xaa can be any amino acid except Pro or Gly
  SITE (27)..(27): Xaa can be any amino acid
  SITE (28)..(28): Xaa can be any amino acid
  SITE (29)..(29): Xaa can be any amino acid
  SITE (31)..(31): Xaa can be any amino acid except Pro or Gly
  SITE (32)..(32): Xaa can be any amino acid except Pro or Gly
  SITE (33)..(33): Xaa can be any amino acid except Pro or Gly
  SITE (34)..(34): Xaa can be any amino acid except Pro or Gly
  SITE (36)..(36): Xaa can be any amino acid
  SITE (37)..(37): Xaa can be any amino acid
  SITE (38)..(38): Xaa can be any amino acid
  SITE (40)..(40): Xaa can be any amino acid except Pro or Gly
  SITE (41)..(41): Xaa can be any amino acid except Pro or Gly
  SITE (42)..(42): Xaa can be any amino acid except Pro or Gly
  SITE (43)..(43): Xaa can be any amino acid except Pro or Gly
  SITE (45)..(45): Xaa can be any amino acid
  SITE (46)..(46): Xaa can be any amino acid
  SITE (47)..(47): Xaa can be any amino acid
  SITE (49)..(49): Xaa can be any amino acid except Pro or Gly
  SITE (50)..(50): Xaa can be any amino acid except Pro or Gly
  SITE (51)..(51): Xaa can be any amino acid except Pro or Gly
  SITE (52)..(52): Xaa can be any amino acid except Pro or Gly
  SITE (54)..(54): Xaa can be any amino acid
  SITE (55)..(55): Xaa can be any amino acid
  SITE (56)..(56): Xaa can be any amino acid
  SITE (58)..(58): Xaa can be any amino acid except Pro or Gly
  SITE (59)..(59): Xaa can be any amino acid except Pro or Gly
  SITE (60)..(60): Xaa can be any amino acid except Pro or Gly
  SITE (61)..(61): Xaa can be any amino acid except Pro or Gly
  SITE (63)..(63): Xaa can be any amino acid
  SITE (64)..(64): Xaa can be any amino acid
  SITE (65)..(65): Xaa can be any amino acid
  SITE (67)..(67): Xaa can be any amino acid except Pro or Gly
  SITE (68)..(68): Xaa can be any amino acid except Pro or Gly
  SITE (69)..(69): Xaa can be any amino acid except Pro or Gly
  SITE (70)..(70): Xaa can be any amino acid except Pro or Gly
  SITE (72)..(72): Xaa can be any amino acid
  SITE (73)..(73): Xaa can be any amino acid
  SITE (74)..(74): Xaa can be any amino acid
  SITE (76)..(76): Xaa can be any amino acid except Pro or Gly
  SITE (77)..(77): Xaa can be any amino acid except Pro or Gly
  SITE (78)..(78): Xaa can be any amino acid except Pro or Gly
  SITE (79)..(79): Xaa can be any amino acid except Pro or Gly
  SITE (81)..(81): Xaa can be any amino acid
  SITE (82)..(82): Xaa can be any amino acid
  SITE (83)..(83): Xaa can be any amino acid
  SITE (85)..(85): Xaa can be any amino acid except Pro or Gly
  SITE (86)..(86): Xaa can be any amino acid except Pro or Gly
  SITE (87)..(87): Xaa can be any amino acid except Pro or Gly
  SITE (88)..(88): Xaa can be any amino acid except Pro or Gly
  SITE (90)..(90): Xaa can be any amino acid
  SITE (91)..(1440): May be present or absent in groups of the repeat unit Xaa Xaa Pro Xaa Xaa Xaa Xaa Gly Xaa
  SITE (91)..(91): Xaa can be any amino acid
  SITE (92)..(92): Xaa can be any amino acid
  SITE (94)..(94): Xaa can be any amino acid except Pro or Gly
  SITE (95)..(95): Xaa can be any amino acid except Pro or Gly
  SITE (96)..(96): Xaa can be any amino acid except Pro or Gly
  SITE (97)..(97): Xaa can be any amino acid except Pro or Gly
  SITE (99)..(99): Xaa can be any amino acid
  SITE (100)..(100): Xaa can be any amino acid
  SITE (101)..(101): Xaa can be any amino acid
  SITE (103)..(103): Xaa can be any amino acid except Pro or Gly
  SITE (104)..(104): Xaa can be any amino acid except Pro or Gly
  SITE (105)..(105): Xaa can be any amino acid except Pro or Gly
  SITE (106)..(106): Xaa can be any amino acid except Pro or Gly
  SITE (108)..(108): Xaa can be any amino acid
  SITE (109)..(109): Xaa can be any amino acid
  SITE (110)..(110): Xaa can be any amino acid
  SITE (112)..(112): Xaa can be any amino acid except Pro or Gly
  SITE (113)..(113): Xaa can be any amino acid except Pro or Gly
  SITE (114)..(114): Xaa can be any amino acid except Pro or Gly
  SITE (115)..(115): Xaa can be any amino acid except Pro or Gly
  SITE (117)..(117): Xaa can be any amino acid
  SITE (118)..(118): Xaa can be any amino acid
  SITE (119)..(119): Xaa can be any amino acid
  SITE (121)..(121): Xaa can be any amino acid except Pro or Gly
  SITE (122)..(122): Xaa can be any amino acid except Pro or Gly
  SITE (123)..(123): Xaa can be any amino acid except Pro or Gly
  SITE (124)..(124): Xaa can be any amino acid except Pro or Gly
  SITE (126)..(126): Xaa can be any amino acid
  SITE (127)..(127): Xaa can be any amino acid
  SITE (128)..(128): Xaa can be any amino acid
  SITE (130)..(130): Xaa can be any amino acid except Pro or Gly
  SITE (131)..(131): Xaa can be any amino acid except Pro or Gly
  SITE (132)..(132): Xaa can be any amino acid except Pro or Gly
  SITE (133)..(133): Xaa can be any amino acid except Pro or Gly
  SITE (135)..(135): Xaa can be any amino acid
  SITE (136)..(136): Xaa can be any amino acid
  SITE (137)..(137): Xaa can be any amino acid
  SITE (139)..(139): Xaa can be any amino acid except Pro or Gly
  SITE (140)..(140): Xaa can be any amino acid except Pro or Gly
  SITE (141)..(141): Xaa can be any amino acid except Pro or Gly
  SITE (142)..(142): Xaa can be any amino acid except Pro or Gly
  SITE (144)..(144): Xaa can be any amino acid
  SITE (145)..(145): Xaa can be any amino acid
  SITE (146)..(146): Xaa can be any amino acid
  SITE (148)..(148): Xaa can be any amino acid except Pro or Gly
  SITE (149)..(149): Xaa can be any amino acid except Pro or Gly
  SITE (150)..(150): Xaa can be any amino acid except Pro or Gly
  SITE (151)..(151): Xaa can be any amino acid except Pro or Gly
  SITE (153)..(153): Xaa can be any amino acid
  SITE (154)..(154): Xaa can be any amino acid
  SITE (155)..(155): Xaa can be any amino acid
  SITE (157)..(157): Xaa can be any amino acid except Pro or Gly
  SITE (158)..(158): Xaa can be any amino acid except Pro or Gly
  SITE (159)..(159): Xaa can be any amino acid except Pro or Gly
  SITE (160)..(160): Xaa can be any amino acid except Pro or Gly
  SITE (162)..(162): Xaa can be any amino acid
  SITE (163)..(163): Xaa can be any amino acid
  SITE (164)..(164): Xaa can be any amino acid
  SITE (166)..(166): Xaa can be any amino acid except Pro or Gly
  SITE (167)..(167): Xaa can be any amino acid except Pro or Gly
  SITE (168)..(168): Xaa can be any amino acid except Pro or Gly
  SITE (169)..(169): Xaa can be any amino acid except Pro or Gly
  SITE (171)..(171): Xaa can be any amino acid
  SITE (172)..(172): Xaa can be any amino acid
  SITE (173)..(173): Xaa can be any amino acid
  SITE (175)..(175): Xaa can be any amino acid except Pro or Gly
  SITE (176)..(176): Xaa can be any amino acid except Pro or Gly
  SITE (177)..(177): Xaa can be any amino acid except Pro or Gly
  SITE (178)..(178): Xaa can be any amino acid except Pro or Gly
  SITE (180)..(180): Xaa can be any amino acid
  SITE (181)..(181): Xaa can be any amino acid
  SITE (182)..(182): Xaa can be any amino acid
  SITE (184)..(184): Xaa can be any amino acid except Pro or Gly
  SITE (185)..(185): Xaa can be any amino acid except Pro or Gly
  SITE (186)..(186): Xaa can be any amino acid except Pro or Gly
  SITE (187)..(187): Xaa can be any amino acid except Pro or Gly
  SITE (189)..(189): Xaa can be any amino acid
  SITE (190)..(190): Xaa can be any amino acid
  SITE (191)..(191): Xaa can be any amino acid
  SITE (193)..(193): Xaa can be any amino acid except Pro or Gly
  SITE (194)..(194): Xaa can be any amino acid except Pro or Gly
  SITE (195)..(195): Xaa can be any amino acid except Pro or Gly
  SITE (196)..(196): Xaa can be any amino acid except Pro or Gly
  SITE (198)..(198): Xaa can be any amino acid
  SITE (199)..(199): Xaa can be any amino acid
  SITE (200)..(200): Xaa can be any amino acid
  SITE (202)..(202): Xaa can be any amino acid except Pro or Gly
  SITE (203)..(203): Xaa can be any amino acid except Pro or Gly
  SITE (204)..(204): Xaa can be any amino acid except Pro or Gly
  SITE (205)..(205): Xaa can be any amino acid except Pro or Gly
  SITE (207)..(207): Xaa can be any amino acid
  SITE (208)..(208): Xaa can be any amino acid
  SITE (209)..(209): Xaa can be any amino acid
  SITE (211)..(211): Xaa can be any amino acid except Pro or Gly
  SITE (212)..(212): Xaa can be any amino acid except Pro or Gly
  SITE (213)..(213): Xaa can be any amino acid except Pro or Gly
  SITE (214)..(214): Xaa can be any amino acid except Pro or Gly
  SITE (216)..(216): Xaa can be any amino acid
  SITE (217)..(217): Xaa can be any amino acid
  SITE (218)..(218): Xaa can be any amino acid
  SITE (220)..(220): Xaa can be any amino acid except Pro or Gly
  SITE (221)..(221): Xaa can be any amino acid except Pro or Gly
  SITE (222)..(222): Xaa can be any amino acid except Pro or Gly
  SITE (223)..(223): Xaa can be any amino acid except Pro or Gly
  SITE (225)..(225): Xaa can be any amino acid
  SITE (226)..(226): Xaa can be any amino acid
  SITE (227)..(227): Xaa can be any amino acid
  SITE (229)..(229): Xaa can be any amino acid except Pro or Gly
  SITE (230)..(230): Xaa can be any amino acid except Pro or Gly
  SITE (231)..(231): Xaa can be any amino acid except Pro or Gly
  SITE (232)..(232): Xaa can be any amino acid except Pro or Gly
  SITE (234)..(234): Xaa can be any amino acid
  SITE (235)..(235): Xaa can be any amino acid
  SITE (236)..(236): Xaa can be any amino acid
  SITE (238)..(238): Xaa can be any amino acid except Pro or Gly
  SITE (239)..(239): Xaa can be any amino acid except Pro or Gly
  SITE (240)..(240): Xaa can be any amino acid except Pro or Gly
  SITE (241)..(241): Xaa can be any amino acid except Pro or Gly
  SITE (243)..(243): Xaa can be any amino acid
  SITE (244)..(244): Xaa can be any amino acid
  SITE (245)..(245): Xaa can be any amino acid
  SITE (247)..(247): Xaa can be any amino acid except Pro or Gly
  SITE (248)..(248): Xaa can be any amino acid except Pro or Gly
  SITE (249)..(249): Xaa can be any amino acid except Pro or Gly
  SITE (250)..(250): Xaa can be any amino acid except Pro or Gly
  SITE (252)..(252): Xaa can be any amino acid
  SITE (253)..(253): Xaa can be any amino acid
  SITE (254)..(254): Xaa can be any amino acid
  SITE (256)..(256): Xaa can be any amino acid except Pro or Gly
  SITE (257)..(257): Xaa can be any amino acid except Pro or Gly
  SITE (258)..(258): Xaa can be any amino acid except Pro or Gly
  SITE (259)..(259): Xaa can be any amino acid except Pro or Gly
  SITE (261)..(261): Xaa can be any amino acid
  SITE (262)..(262): Xaa can be any amino acid
  SITE (263)..(263): Xaa can be any amino acid
  SITE (265)..(265): Xaa can be any amino acid except Pro or Gly
  SITE (266)..(266): Xaa can be any amino acid except Pro or Gly
  SITE (267)..(267): Xaa can be any amino acid except Pro or Gly
  SITE (268)..(268): Xaa can be any amino acid except Pro or Gly
  SITE (270)..(270): Xaa can be any amino acid
  SITE (271)..(271): Xaa can be any amino acid
  SITE (272)..(272): Xaa can be any amino acid
  SITE (274)..(274): Xaa can be any amino acid except Pro or Gly
  SITE (275)..(275): Xaa can be any amino acid except Pro or Gly
  SITE (276)..(276): Xaa can be any amino acid except Pro or Gly
  SITE (277)..(277): Xaa can be any amino acid except Pro or Gly
  SITE (279)..(279): Xaa can be any amino acid
  SITE (280)..(280): Xaa can be any amino acid
  SITE (281)..(281): Xaa can be any amino acid
  SITE (283)..(283): Xaa can be any amino acid except Pro or Gly
  SITE (284)..(284): Xaa can be any amino acid except Pro or Gly
  SITE (285)..(285): Xaa can be any amino acid except Pro or Gly
  SITE (286)..(286): Xaa can be any amino acid except Pro or Gly
  SITE (288)..(288): Xaa can be any amino acid
  SITE (289)..(289): Xaa can be any amino acid
  SITE (290)..(290): Xaa can be any amino acid
  SITE (292)..(292): Xaa can be any amino acid except Pro or Gly
  SITE (293)..(293): Xaa can be any amino acid except Pro or Gly
  SITE (294)..(294): Xaa can be any amino acid except Pro or Gly
  SITE (295)..(295): Xaa can be any amino acid except Pro or Gly
  SITE (297)..(297): Xaa can be any amino acid
  SITE (298)..(298): Xaa can be any amino acid
  SITE (299)..(299): Xaa can be any amino acid
  SITE (301)..(301): Xaa can be any amino acid except Pro or Gly
  SITE (302)..(302): Xaa can be any amino acid except Pro or Gly
  SITE (303)..(303): Xaa can be any amino acid except Pro or Gly
  SITE (304)..(304): Xaa can be any amino acid except Pro or Gly
  SITE (306)..(306): Xaa can be any amino acid
  SITE (307)..(307): Xaa can be any amino acid
  SITE (308)..(308): Xaa can be any amino acid
  SITE (310)..(310): Xaa can be any amino acid except Pro or Gly
  SITE (311)..(311): Xaa can be any amino acid except Pro or Gly
  SITE (312)..(312): Xaa can be any amino acid except Pro or Gly
  SITE (313)..(313): Xaa can be any amino acid except Pro or Gly
  SITE (315)..(315): Xaa can be any amino acid
  SITE (316)..(316): Xaa can be any amino acid
  SITE (317)..(317): Xaa can be any amino acid
  SITE (319)..(319): Xaa can be any amino acid except Pro or Gly
  SITE (320)..(320): Xaa can be any amino acid except Pro or Gly
  SITE (321)..(321): Xaa can be any amino acid except Pro or Gly
  SITE (322)..(322): Xaa can be any amino acid except Pro or Gly
  SITE (324)..(324): Xaa can be any amino acid
  SITE (325)..(325): Xaa can be any amino acid
  SITE (326)..(326): Xaa can be any amino acid
  SITE (328)..(328): Xaa can be any amino acid except Pro or Gly
  SITE (329)..(329): Xaa can be any amino acid except Pro or Gly
  SITE (330)..(330): Xaa can be any amino acid except Pro or Gly
  SITE (331)..(331): Xaa can be any amino acid except Pro or Gly
  SITE (333)..(333): Xaa can be any amino acid
  SITE (334)..(334): Xaa can be any amino acid
  SITE (335)..(335): Xaa can be any amino acid
  SITE (337)..(337): Xaa can be any amino acid except Pro or Gly
  SITE (338)..(338): Xaa can be any amino acid except Pro or Gly
  SITE (339)..(339): Xaa can be any amino acid except Pro or Gly
  SITE (340)..(340): Xaa can be any amino acid except Pro or Gly
  SITE (342)..(342): Xaa can be any amino acid
  SITE (343)..(343): Xaa can be any amino acid
  SITE (344)..(344): Xaa can be any amino acid
  SITE (346)..(346): Xaa can be any amino acid except Pro or Gly
  SITE (347)..(347): Xaa can be any amino acid except Pro or Gly
  SITE (348)..(348): Xaa can be any amino acid except Pro or Gly
  SITE (349)..(349): Xaa can be any amino acid except Pro or Gly
  SITE (351)..(351): Xaa can be any amino acid
  SITE (352)..(352): Xaa can be any amino acid
  SITE (353)..(353): Xaa can be any amino acid
  SITE (355)..(355): Xaa can be any amino acid except Pro or Gly
  SITE (356)..(356): Xaa can be any amino acid except Pro or Gly
  SITE (357)..(357): Xaa can be any amino acid except Pro or Gly
  SITE (358)..(358): Xaa can be any amino acid except Pro or Gly
  SITE (360)..(360): Xaa can be any amino acid
  SITE (361)..(361): Xaa can be any amino acid
  SITE (362)..(362): Xaa can be any amino acid
  SITE (364)..(364): Xaa can be any amino acid except Pro or Gly
  SITE (365)..(365): Xaa can be any amino acid except Pro or Gly
  SITE (366)..(366): Xaa can be any amino acid except Pro or Gly
  SITE (367)..(367): Xaa can be any amino acid except Pro or Gly
  SITE (369)..(369): Xaa can be any amino acid
  SITE (370)..(370): Xaa can be any amino acid
  SITE (371)..(371): Xaa can be any amino acid
  SITE (373)..(373): Xaa can be any amino acid except Pro or Gly
  SITE (374)..(374): Xaa can be any amino acid except Pro or Gly
  SITE (375)..(375): Xaa can be any amino acid except Pro or Gly
  SITE (376)..(376): Xaa can be any amino acid except Pro or Gly
  SITE (378)..(378): Xaa can be any amino acid
  SITE (379)..(379): Xaa can be any amino acid
  SITE (380)..(380): Xaa can be any amino acid
  SITE (382)..(382): Xaa can be any amino acid except Pro or Gly
  SITE (383)..(383): Xaa can be any amino acid except Pro or Gly
  SITE (384)..(384): Xaa can be any amino acid except Pro or Gly
  SITE (385)..(385): Xaa can be any amino acid except Pro or Gly
  SITE (387)..(387): Xaa can be any amino acid
  SITE (388)..(388): Xaa can be any amino acid
  SITE (389)..(389): Xaa can be any amino acid
  SITE (391)..(391): Xaa can be any amino acid except Pro or Gly
  SITE (392)..(392): Xaa can be any amino acid except Pro or Gly
  SITE (393)..(393): Xaa can be any amino acid except Pro or Gly
  SITE (394)..(394): Xaa can be any amino acid except Pro or Gly
  SITE (396)..(396): Xaa can be any amino acid
  SITE (397)..(397): Xaa can be any amino acid
  SITE (398)..(398): Xaa can be any amino acid
  SITE (400)..(400): Xaa can be any amino acid except Pro or Gly
  SITE (401)..(401): Xaa can be any amino acid except Pro or Gly
  SITE (402)..(402): Xaa can be any amino acid except Pro or Gly
  SITE (403)..(403): Xaa can be any amino acid except Pro or Gly
  SITE (405)..(405): Xaa can be any amino acid
  SITE (406)..(406): Xaa can be any amino acid
  SITE (407)..(407): Xaa can be any amino acid
  SITE (409)..(409): Xaa can be any amino acid except Pro or Gly
  SITE (410)..(410): Xaa can be any amino acid except Pro or Gly
  SITE (411)..(411): Xaa can be any amino acid except Pro or Gly
  SITE (412)..(412): Xaa can be any amino acid except Pro or Gly
  SITE (414)..(414): Xaa can be any amino acid
  SITE (415)..(415): Xaa can be any amino acid
  SITE (416)..(416): Xaa can be any amino acid
  SITE (418)..(418): Xaa can be any amino acid except Pro or Gly
  SITE (419)..(419): Xaa can be any amino acid except Pro or Gly
  SITE (420)..(420): Xaa can be any amino acid except Pro or Gly
  SITE (421)..(421): Xaa can be any amino acid except Pro or Gly
  SITE (423)..(423): Xaa can be any amino acid
  SITE (424)..(424): Xaa can be any amino acid
  SITE (425)..(425): Xaa can be any amino acid
  SITE (427)..(427): Xaa can be any amino acid except Pro or Gly
  SITE (428)..(428): Xaa can be any amino acid except Pro or Gly
  SITE (429)..(429): Xaa can be any amino acid except Pro or Gly
  SITE (430)..(430): Xaa can be any amino acid except Pro or Gly
  SITE (432)..(432): Xaa can be any amino acid
  SITE (433)..(433): Xaa can be any amino acid
  SITE (434)..(434): Xaa can be any amino acid
  SITE (436)..(436): Xaa can be any amino acid except Pro or Gly
  SITE (437)..(437): Xaa can be any amino acid except Pro or Gly
  SITE (438)..(438): Xaa can be any amino acid except Pro or Gly
  SITE (439)..(439): Xaa can be any amino acid except Pro or Gly
  SITE (441)..(441): Xaa can be any amino acid
  SITE (442)..(442): Xaa can be any amino acid
  SITE (443)..(443): Xaa can be any amino acid
  SITE (445)..(445): Xaa can be any amino acid except Pro or Gly
  SITE (446)..(446): Xaa can be any amino acid except Pro or Gly
  SITE (447)..(447): Xaa can be any amino acid except Pro or Gly
  SITE (448)..(448): Xaa can be any amino acid except Pro or Gly
  SITE (450)..(450): Xaa can be any amino acid
  SITE (451)..(451): Xaa can be any amino acid
  SITE (452)..(452): Xaa can be any amino acid
  SITE (454)..(454): Xaa can be any amino acid except Pro or Gly
  SITE (455)..(455): Xaa can be any amino acid except Pro or Gly
  SITE (456)..(456): Xaa can be any amino acid except Pro or Gly
  SITE (457)..(457): Xaa can be any amino acid except Pro or Gly
  SITE (459)..(459): Xaa can be any amino acid
  SITE (460)..(460): Xaa can be any amino acid
  SITE (461)..(461): Xaa can be any amino acid
  SITE (463)..(463): Xaa can be any amino acid except Pro or Gly
  SITE (464)..(464): Xaa can be any amino acid except Pro or Gly
  SITE (465)..(465): Xaa can be any amino acid except Pro or Gly
  SITE (466)..(466): Xaa can be any amino acid except Pro or Gly
  SITE (468)..(468): Xaa can be any amino acid
  SITE (469)..(469): Xaa can be any amino acid
  SITE (470)..(470): Xaa can be any amino acid
  SITE (472)..(472): Xaa can be any amino acid except Pro or Gly
  SITE (473)..(473): Xaa can be any amino acid except Pro or Gly
  SITE (474)..(474): Xaa can be any amino acid except Pro or Gly
  SITE (475)..(475): Xaa can be any amino acid except Pro or Gly
  SITE (477)..(477): Xaa can be any amino acid
  SITE (478)..(478): Xaa can be any amino acid
  SITE (479)..(479): Xaa can be any amino acid
  SITE (481)..(481): Xaa can be any amino acid except Pro or Gly
  SITE (482)..(482): Xaa can be any amino acid except Pro or Gly
  SITE (483)..(483): Xaa can be any amino acid except Pro or Gly
  SITE (484)..(484): Xaa can be any amino acid except Pro or Gly
  SITE (486)..(486): Xaa can be any amino acid
  SITE (487)..(487): Xaa can be any amino acid
  SITE (488)..(488): Xaa can be any amino acid
  SITE (490)..(490): Xaa can be any amino acid except Pro or Gly
  SITE (491)..(491): Xaa can be any amino acid except Pro or Gly
  SITE (492)..(492): Xaa can be any amino acid except Pro or Gly
  SITE (493)..(493): Xaa can be any amino acid except Pro or Gly
  SITE (495)..(495): Xaa can be any amino acid
  SITE (496)..(496): Xaa can be any amino acid
  SITE (497)..(497): Xaa can be any amino acid
  SITE (499)..(499): Xaa can be any amino acid except Pro or Gly
  SITE (500)..(500): Xaa can be any amino acid except Pro or Gly
  SITE (501)..(501): Xaa can be any amino acid except Pro or Gly
  SITE (502)..(502): Xaa can be any amino acid except Pro or Gly
  SITE (504)..(504): Xaa can be any amino acid
  SITE (505)..(505): Xaa can be any amino acid
  SITE (506)..(506): Xaa can be any amino acid
  SITE (508)..(508): Xaa can be any amino acid except Pro or Gly
  SITE (509)..(509): Xaa can be any amino acid except Pro or Gly
  SITE (510)..(510): Xaa can be any amino acid except Pro or Gly
  SITE (511)..(511): Xaa can be any amino acid except Pro or Gly
  SITE (513)..(513): Xaa can be any amino acid
  SITE (514)..(514): Xaa can be any amino acid
  SITE (515)..(515): Xaa can be any amino acid
  SITE (517)..(517): Xaa can be any amino acid except Pro or Gly
  SITE (518)..(518): Xaa can be any amino acid except Pro or Gly
  SITE (519)..(519): Xaa can be any amino acid except Pro or Gly
  SITE (520)..(520): Xaa can be any amino acid except Pro or Gly
  SITE (522)..(522): Xaa can be any amino acid
  SITE (523)..(523): Xaa can be any amino acid
  SITE (524)..(524): Xaa can be any amino acid
  SITE (526)..(526): Xaa can be any amino acid except Pro or Gly
  SITE (527)..(527): Xaa can be any amino acid except Pro or Gly
  SITE (528)..(528): Xaa can be any amino acid except Pro or Gly
  SITE (529)..(529): Xaa can be any amino acid except Pro or Gly
  SITE (531)..(531): Xaa can be any amino acid
  SITE (532)..(532): Xaa can be any amino acid
  SITE (533)..(533): Xaa can be any amino acid
  SITE (535)..(535): Xaa can be any amino acid except Pro or Gly
  SITE (536)..(536): Xaa can be any amino acid except Pro or Gly
  SITE (537)..(537): Xaa can be any amino acid except Pro or Gly
  SITE (538)..(538): Xaa can be any amino acid except Pro or Gly
  SITE (540)..(540): Xaa can be any amino acid
  SITE (541)..(541): Xaa can be any amino acid
  SITE (542)..(542): Xaa can be any amino acid
  SITE (544)..(544): Xaa can be any amino acid except Pro or Gly
  SITE (545)..(545): Xaa can be any amino acid except Pro or Gly
  SITE (546)..(546): Xaa can be any amino acid except Pro or Gly
  SITE (547)..(547): Xaa can be any amino acid except Pro or Gly
  SITE (549)..(549): Xaa can be any amino acid
  SITE (550)..(550): Xaa can be any amino acid
  SITE (551)..(551): Xaa can be any amino acid
  SITE (553)..(553): Xaa can be any amino acid except Pro or Gly
  SITE (554)..(554): Xaa can be any amino acid except Pro or Gly
  SITE (555)..(555): Xaa can be any amino acid except Pro or Gly
  SITE (556)..(556): Xaa can be any amino acid except Pro or Gly
  SITE (558)..(558): Xaa can be any amino acid
  SITE (559)..(559): Xaa can be any amino acid
  SITE (560)..(560): Xaa can be any amino acid
  SITE (562)..(562): Xaa can be any amino acid except Pro or Gly
  SITE (563)..(563): Xaa can be any amino acid except Pro or Gly
  SITE (564)..(564): Xaa can be any amino acid except Pro or Gly
  SITE (565)..(565): Xaa can be any amino acid except Pro or Gly
  SITE (567)..(567): Xaa can be any amino acid
  SITE (568)..(568): Xaa can be any amino acid
  SITE (569)..(569): Xaa can be any amino acid
  SITE (571)..(571): Xaa can be any amino acid except Pro or Gly
  SITE (572)..(572): Xaa can be any amino acid except Pro or Gly
  SITE (573)..(573): Xaa can be any amino acid except Pro or Gly
  SITE (574)..(574): Xaa can be any amino acid except Pro or Gly
  SITE (576)..(576): Xaa can be any amino acid
  SITE (577)..(577): Xaa can be any amino acid
  SITE (578)..(578): Xaa can be any amino acid
  SITE (580)..(580): Xaa can be any amino acid except Pro or Gly
  SITE (581)..(581): Xaa can be any amino acid except Pro or Gly
  SITE (582)..(582): Xaa can be any amino acid except Pro or Gly
  SITE (583)..(583): Xaa can be any amino acid except Pro or Gly
  SITE (585)..(585): Xaa can be any amino acid
  SITE (586)..(586): Xaa can be any amino acid
  SITE (587)..(587): Xaa can be any amino acid
  SITE (589)..(589): Xaa can be any amino acid except Pro or Gly
  SITE (590)..(590): Xaa can be any amino acid except Pro or Gly
  SITE (591)..(591): Xaa can be any amino acid except Pro or Gly
  SITE (592)..(592): Xaa can be any amino acid except Pro or Gly
  SITE (594)..(594): Xaa can be any amino acid
  SITE (595)..(595): Xaa can be any amino acid
  SITE (596)..(596): Xaa can be any amino acid
  SITE (598)..(598): Xaa can be any amino acid except Pro or Gly
  SITE (599)..(599): Xaa can be any amino acid except Pro or Gly
  SITE (600)..(600): Xaa can be any amino acid except Pro or Gly
  SITE (601)..(601): Xaa can be any amino acid except Pro or Gly
  SITE (603)..(603): Xaa can be any amino acid
  SITE (604)..(604): Xaa can be any amino acid
  SITE (605)..(605): Xaa can be any amino acid
  SITE (607)..(607): Xaa can be any amino acid except Pro or Gly
  SITE (608)..(608): Xaa can be any amino acid except Pro or Gly
  SITE (609)..(609): Xaa can be any amino acid except Pro or Gly
  SITE (610)..(610): Xaa can be any amino acid except Pro or Gly
  SITE (612)..(612): Xaa can be any amino acid
  SITE (613)..(613): Xaa can be any amino acid
  SITE (614)..(614): Xaa can be any amino acid
  SITE (616)..(616): Xaa can be any amino acid except Pro or Gly
  SITE (617)..(617): Xaa can be any amino acid except Pro or Gly
  SITE (618)..(618): Xaa can be any amino acid except Pro or Gly
  SITE (619)..(619): Xaa can be any amino acid except Pro or Gly
  SITE (621)..(621): Xaa can be any amino acid
  SITE (622)..(622): Xaa can be any amino acid
  SITE (623)..(623): Xaa can be any amino acid
  SITE (625)..(625): Xaa can be any amino acid except Pro or Gly
  SITE (626)..(626): Xaa can be any amino acid except Pro or Gly
  SITE (627)..(627): Xaa can be any amino acid except Pro or Gly
  SITE (628)..(628): Xaa can be any amino acid except Pro or Gly
  SITE (630)..(630): Xaa can be any amino acid
  SITE (631)..(631): Xaa can be any amino acid
  SITE (632)..(632): Xaa can be any amino acid
  SITE (634)..(634): Xaa can be any amino acid except Pro or Gly
  SITE (635)..(635): Xaa can be any amino acid except Pro or Gly
  SITE (636)..(636): Xaa can be any amino acid except Pro or Gly
  SITE (637)..(637): Xaa can be any amino acid except Pro or Gly
  SITE (639)..(639): Xaa can be any amino acid
  SITE (640)..(640): Xaa can be any amino acid
  SITE (641)..(641): Xaa can be any amino acid
  SITE (643)..(643): Xaa can be any amino acid except Pro or Gly
  SITE (644)..(644): Xaa can be any amino acid except Pro or Gly
  SITE (645)..(645): Xaa can be any amino acid except Pro or Gly
  SITE (646)..(646): Xaa can be any amino acid except Pro or Gly
  SITE (648)..(648): Xaa can be any amino acid
  SITE (649)..(649): Xaa can be any amino acid
  SITE (650)..(650): Xaa can be any amino acid
  SITE (652)..(652): Xaa can be any amino acid except Pro or Gly
  SITE (653)..(653): Xaa can be any amino acid except Pro or Gly
  SITE (654)..(654): Xaa can be any amino acid except Pro or Gly
  SITE (655)..(655): Xaa can be any amino acid except Pro or Gly
  SITE (657)..(657): Xaa can be any amino acid
  SITE (658)..(658): Xaa can be any amino acid
  SITE (659)..(659): Xaa can be any amino acid
  SITE (661)..(661): Xaa can be any amino acid except Pro or Gly
  SITE (662)..(662): Xaa can be any amino acid except Pro or Gly
  SITE (663)..(663): Xaa can be any amino acid except Pro or Gly
  SITE (664)..(664): Xaa can be any amino acid except Pro or Gly
  SITE (666)..(666): Xaa can be any amino acid
  SITE (667)..(667): Xaa can be any amino acid
  SITE (668)..(668): Xaa can be any amino acid
  SITE (670)..(670): Xaa can be any amino acid except Pro or Gly
  SITE (671)..(671): Xaa can be any amino acid except Pro or Gly
  SITE (672)..(672): Xaa can be any amino acid except Pro or Gly
  SITE (673)..(673): Xaa can be any amino acid except Pro or Gly
  SITE (675)..(675): Xaa can be any amino acid
  SITE (676)..(676): Xaa can be any amino acid
  SITE (677)..(677): Xaa can be any amino acid
  SITE (679)..(679): Xaa can be any amino acid except Pro or Gly
  SITE (680)..(680): Xaa can be any amino acid except Pro or Gly
  SITE (681)..(681): Xaa can be any amino acid except Pro or Gly
  SITE (682)..(682): Xaa can be any amino acid except Pro or Gly
  SITE (684)..(684): Xaa can be any amino acid
  SITE (685)..(685): Xaa can be any amino acid
  SITE (686)..(686): Xaa can be any amino acid
  SITE (688)..(688): Xaa can be any amino acid except Pro or Gly
  SITE (689)..(689): Xaa can be any amino acid except Pro or Gly
  SITE (690)..(690): Xaa can be any amino acid except Pro or Gly
  SITE (691)..(691): Xaa can be any amino acid except Pro or Gly
  SITE (693)..(693): Xaa can be any amino acid
  SITE (694)..(694): Xaa can be any amino acid
  SITE (695)..(695): Xaa can be any amino acid
  SITE (697)..(697): Xaa can be any amino acid except Pro or Gly
  SITE (698)..(698): Xaa can be any amino acid except Pro or Gly
  SITE (699)..(699): Xaa can be any amino acid except Pro or Gly
  SITE (700)..(700): Xaa can be any amino acid except Pro or Gly
  SITE (702)..(702): Xaa can be any amino acid
  SITE (703)..(703): Xaa can be any amino acid
  SITE (704)..(704): Xaa can be any amino acid
  SITE (706)..(706): Xaa can be any amino acid except Pro or Gly
  SITE (707)..(707): Xaa can be any amino acid except Pro or Gly
  SITE (708)..(708): Xaa can be any amino acid except Pro or Gly
  SITE (709)..(709): Xaa can be any amino acid except Pro or Gly
  SITE (711)..(711): Xaa can be any amino acid
  SITE (712)..(712): Xaa can be any amino acid
  SITE (713)..(713): Xaa can be any amino acid
  SITE (715)..(715): Xaa can be any amino acid except Pro or Gly
  SITE (716)..(716): Xaa can be any amino acid except Pro or Gly
  SITE (717)..(717): Xaa can be any amino acid except Pro or Gly
  SITE (718)..(718): Xaa can be any amino acid except Pro or Gly
  SITE (720)..(720): Xaa can be any amino acid
  SITE (721)..(721): Xaa can be any amino acid
  SITE (722)..(722): Xaa can be any amino acid
  SITE (724)..(724): Xaa can be any amino acid except Pro or Gly
  SITE (725)..(725): Xaa can be any amino acid except Pro or Gly
  SITE (726)..(726): Xaa can be any amino acid except Pro or Gly
  SITE (727)..(727): Xaa can be any amino acid except Pro or Gly
  SITE (729)..(729): Xaa can be any amino acid
  SITE (730)..(730): Xaa can be any amino acid
  SITE (731)..(731): Xaa can be any amino acid
  SITE (733)..(733): Xaa can be any amino acid except Pro or Gly
  SITE (734)..(734): Xaa can be any amino acid except Pro or Gly
  SITE (735)..(735): Xaa can be any amino acid except Pro or Gly
  SITE (736)..(736): Xaa can be any amino acid except Pro or Gly
  SITE (738)..(738): Xaa can be any amino acid
  SITE (739)..(739): Xaa can be any amino acid
  SITE (740)..(740): Xaa can be any amino acid
  SITE (742)..(742): Xaa can be any amino acid except Pro or Gly
  SITE (743)..(743): Xaa can be any amino acid except Pro or Gly
  SITE (744)..(744): Xaa can be any amino acid except Pro or Gly
  SITE (745)..(745): Xaa can be any amino acid except Pro or Gly
  SITE (747)..(747): Xaa can be any amino acid
  SITE (748)..(748): Xaa can be any amino acid
  SITE (749)..(749): Xaa can be any amino acid
  SITE (751)..(751): Xaa can be any amino acid except Pro or Gly
  SITE (752)..(752): Xaa can be any amino acid except Pro or Gly
  SITE (753)..(753): Xaa can be any amino acid except Pro or Gly
  SITE (754)..(754): Xaa can be any amino acid except Pro or Gly
  SITE (756)..(756): Xaa can be any amino acid
  SITE (757)..(757): Xaa can be any amino acid
  SITE (758)..(758): Xaa can be any amino acid
  SITE (760)..(760): Xaa can be any amino acid except Pro or Gly
  SITE (761)..(761): Xaa can be any amino acid except Pro or Gly
  SITE (762)..(762): Xaa can be any amino acid except Pro or Gly
  SITE (763)..(763): Xaa can be any amino acid except Pro or Gly
  SITE (765)..(765): Xaa can be any amino acid
  SITE (766)..(766): Xaa can be any amino acid
  SITE (767)..(767): Xaa can be any amino acid
  SITE (769)..(769): Xaa can be any amino acid except Pro or Gly
  SITE (770)..(770): Xaa can be any amino acid except Pro or Gly
  SITE (771)..(771): Xaa can be any amino acid except Pro or Gly
  SITE (772)..(772): Xaa can be any amino acid except Pro or Gly
  SITE (774)..(774): Xaa can be any amino acid
  SITE (775)..(775): Xaa can be any amino acid
  SITE (776)..(776): Xaa can be any amino acid
  SITE (778)..(778): Xaa can be any amino acid except Pro or Gly
  SITE (779)..(779): Xaa can be any amino acid except Pro or Gly
  SITE (780)..(780): Xaa can be any amino acid except Pro or Gly
  SITE (781)..(781): Xaa can be any amino acid except Pro or Gly
  SITE (783)..(783): Xaa can be any amino acid
  SITE (784)..(784): Xaa can be any amino acid
  SITE (785)..(785): Xaa can be any amino acid
  SITE (787)..(787): Xaa can be any amino acid except Pro or Gly
  SITE (788)..(788): Xaa can be any amino acid except Pro or Gly
  SITE (789)..(789): Xaa can be any amino acid except Pro or Gly
  SITE (790)..(790): Xaa can be any amino acid except Pro or Gly
  SITE (792)..(792): Xaa can be any amino acid
  SITE (793)..(793): Xaa can be any amino acid
  SITE (794)..(794): Xaa can be any amino acid
  SITE (796)..(796): Xaa can be any amino acid except Pro or Gly
  SITE (797)..(797): Xaa can be any amino acid except Pro or Gly
  SITE (798)..(798): Xaa can be any amino acid except Pro or Gly
  SITE (799)..(799): Xaa can be any amino acid except Pro or Gly
  SITE (801)..(801): Xaa can be any amino acid
  SITE (802)..(802): Xaa can be any amino acid
  SITE (803)..(803): Xaa can be any amino acid
  SITE (805)..(805): Xaa can be any amino acid except Pro or Gly
  SITE (806)..(806): Xaa can be any amino acid except Pro or Gly
  SITE (807)..(807): Xaa can be any amino acid except Pro or Gly
  SITE (808)..(808): Xaa can be any amino acid except Pro or Gly
  SITE (810)..(810): Xaa can be any amino acid
  SITE (811)..(811): Xaa can be any amino acid
  SITE (812)..(812): Xaa can be any amino acid
  SITE (814)..(814): Xaa can be any amino acid except Pro or Gly
  SITE (815)..(815): Xaa can be any amino acid except Pro or Gly
  SITE (816)..(816): Xaa can be any amino acid except Pro or Gly
  SITE (817)..(817): Xaa can be any amino acid except Pro or Gly
  SITE (819)..(819): Xaa can be any amino acid
  SITE (820)..(820): Xaa can be any amino acid
  SITE (821)..(821): Xaa can be any amino acid
  SITE (823)..(823): Xaa can be any amino acid except Pro or Gly
  SITE (824)..(824): Xaa can be any amino acid except Pro or Gly
  SITE (825)..(825): Xaa can be any amino acid except Pro or Gly
  SITE (826)..(826): Xaa can be any amino acid except Pro or Gly
  SITE (828)..(828): Xaa can be any amino acid
  SITE (829)..(829): Xaa can be any amino acid
  SITE (830)..(830): Xaa can be any amino acid
  SITE (832)..(832): Xaa can be any amino acid except Pro or Gly
  SITE (833)..(833): Xaa can be any amino acid except Pro or Gly
  SITE (834)..(834): Xaa can be any amino acid except Pro or Gly
  SITE (835)..(835): Xaa can be any amino acid except Pro or Gly
  SITE (837)..(837): Xaa can be any amino acid
  SITE (838)..(838): Xaa can be any amino acid
  SITE (839)..(839): Xaa can be any amino acid
  SITE (841)..(841): Xaa can be any amino acid except Pro or Gly
  SITE (842)..(842): Xaa can be any amino acid except Pro or Gly
  SITE (843)..(843): Xaa can be any amino acid except Pro or Gly
  SITE (844)..(844): Xaa can be any amino acid except Pro or Gly
  SITE (846)..(846): Xaa can be any amino acid
  SITE (847)..(847): Xaa can be any amino acid
  SITE (848)..(848): Xaa can be any amino acid
  SITE (850)..(850): Xaa can be any amino acid except Pro or Gly
  SITE (851)..(851): Xaa can be any amino acid except Pro or Gly
  SITE (852)..(852): Xaa can be any amino acid except Pro or Gly
  SITE (853)..(853): Xaa can be any amino acid except Pro or Gly
  SITE (855)..(855): Xaa can be any amino acid
  SITE (856)..(856): Xaa can be any amino acid
  SITE (857)..(857): Xaa can be any amino acid
  SITE (859)..(859): Xaa can be any amino acid except Pro or Gly
  SITE (860)..(860): Xaa can be any amino acid except Pro or Gly
  SITE (861)..(861): Xaa can be any amino acid except Pro or Gly
  SITE (862)..(862): Xaa can be any amino acid except Pro or Gly
  SITE (864)..(864): Xaa can be any amino acid
  SITE (865)..(865): Xaa can be any amino acid
  SITE (866)..(866): Xaa can be any amino acid
  SITE (868)..(868): Xaa can be any amino acid except Pro or Gly
  SITE (869)..(869): Xaa can be any amino acid except Pro or Gly
  SITE (870)..(870): Xaa can be any amino acid except Pro or Gly
  SITE (871)..(871): Xaa can be any amino acid except Pro or Gly
  SITE (873)..(873): Xaa can be any amino acid
  SITE (874)..(874): Xaa can be any amino acid
  SITE (875)..(875): Xaa can be any amino acid
  SITE (877)..(877): Xaa can be any amino acid except Pro or Gly
  SITE (878)..(878): Xaa can be any amino acid except Pro or Gly
  SITE (879)..(879): Xaa can be any amino acid except Pro or Gly
  SITE (880)..(880): Xaa can be any amino acid except Pro or Gly
  SITE (882)..(882): Xaa can be any amino acid
  SITE (883)..(883): Xaa can be any amino acid
  SITE (884)..(884): Xaa can be any amino acid
  SITE (886)..(886): Xaa can be any amino acid except Pro or Gly
  SITE (887)..(887): Xaa can be any amino acid except Pro or Gly
  SITE (888)..(888): Xaa can be any amino acid except Pro or Gly
  SITE (889)..(889): Xaa can be any amino acid except Pro or Gly
  SITE (891)..(891): Xaa can be any amino acid
  SITE (892)..(892): Xaa can be any amino acid
  SITE (893)..(893): Xaa can be any amino acid
  SITE (895)..(895): Xaa can be any amino acid except Pro or Gly
  SITE (896)..(896): Xaa can be any amino acid except Pro or Gly
  SITE (897)..(897): Xaa can be any amino acid except Pro or Gly
  SITE (898)..(898): Xaa can be any amino acid except Pro or Gly
  SITE (900)..(900): Xaa can be any amino acid
  SITE (901)..(901): Xaa can be any amino acid
  SITE (902)..(902): Xaa can be any amino acid
  SITE (904)..(904): Xaa can be any amino acid except Pro or Gly
  SITE (905)..(905): Xaa can be any amino acid except Pro or Gly
  SITE (906)..(906): Xaa can be any amino acid except Pro or Gly
  SITE (907)..(907): Xaa can be any amino acid except Pro or Gly
  SITE (909)..(909): Xaa can be any amino acid
  SITE (910)..(910): Xaa can be any amino acid
  SITE (911)..(911): Xaa can be any amino acid
  SITE (913)..(913): Xaa can be any amino acid except Pro or Gly
  SITE (914)..(914): Xaa can be any amino acid except Pro or Gly
  SITE (915)..(915): Xaa can be any amino acid except Pro or Gly
  SITE (916)..(916): Xaa can be any amino acid except Pro or Gly
  SITE (918)..(918): Xaa can be any amino acid
  SITE (919)..(919): Xaa can be any amino acid
  SITE (920)..(920): Xaa can be any amino acid
  SITE (922)..(922): Xaa can be any amino acid except Pro or Gly
  SITE (923)..(923): Xaa can be any amino acid except Pro or Gly
  SITE (924)..(924): Xaa can be any amino acid except Pro or Gly
  SITE (925)..(925): Xaa can be any amino acid except Pro or Gly
  SITE (927)..(927): Xaa can be any amino acid
  SITE (928)..(928): Xaa can be any amino acid
  SITE (929)..(929): Xaa can be any amino acid
  SITE (931)..(931): Xaa can be any amino acid except Pro or Gly
  SITE (932)..(932): Xaa can be any amino acid except Pro or Gly
  SITE (933)..(933): Xaa can be any amino acid except Pro or Gly
  SITE (934)..(934): Xaa can be any amino acid except Pro or Gly
  SITE (936)..(936): Xaa can be any amino acid
  SITE (937)..(937): Xaa can be any amino acid
  SITE (938)..(938): Xaa can be any amino acid
  SITE (940)..(940): Xaa can be any amino acid except Pro or Gly
  SITE (941)..(941): Xaa can be any amino acid except Pro or Gly
  SITE (942)..(942): Xaa can be any amino acid except Pro or Gly
  SITE (943)..(943): Xaa can be any amino acid except Pro or Gly
  SITE (945)..(945): Xaa can be any amino acid
  SITE (946)..(946): Xaa can be any amino acid
  SITE (947)..(947): Xaa can be any amino acid
  SITE (949)..(949): Xaa can be any amino acid except Pro or Gly
  SITE (950)..(950): Xaa can be any amino acid except Pro or Gly
  SITE (951)..(951): Xaa can be any amino acid except Pro or Gly
  SITE (952)..(952): Xaa can be any amino acid except Pro or Gly
  SITE (954)..(954): Xaa can be any amino acid
  SITE (955)..(955): Xaa can be any amino acid
  SITE (956)..(956): Xaa can be any amino acid
  SITE (958)..(958): Xaa can be any amino acid except Pro or Gly
  SITE (959)..(959): Xaa can be any amino acid except Pro or Gly
  SITE (960)..(960): Xaa can be any amino acid except Pro or Gly
  SITE (961)..(961): Xaa can be any amino acid except Pro or Gly
  SITE (963)..(963): Xaa can be any amino acid
  SITE (964)..(964): Xaa can be any amino acid
  SITE (965)..(965): Xaa can be any amino acid
  SITE (967)..(967): Xaa can be any amino acid except Pro or Gly
  SITE (968)..(968): Xaa can be any amino acid except Pro or Gly
  SITE (969)..(969): Xaa can be any amino acid except Pro or Gly
  SITE (970)..(970): Xaa can be any amino acid except Pro or Gly
  SITE (972)..(972): Xaa can be any amino acid
  SITE (973)..(973): Xaa can be any amino acid
  SITE (974)..(974): Xaa can be any amino acid
  SITE (976)..(976): Xaa can be any amino acid except Pro or Gly
  SITE (977)..(977): Xaa can be any amino acid except Pro or Gly
  SITE (978)..(978): Xaa can be any amino acid except Pro or Gly
  SITE (979)..(979): Xaa can be any amino acid except Pro or Gly
  SITE (981)..(981): Xaa can be any amino acid
  SITE (982)..(982): Xaa can be any amino acid
  SITE (983)..(983): Xaa can be any amino acid
  SITE (985)..(985): Xaa can be any amino acid except Pro or Gly
  SITE (986)..(986): Xaa can be any amino acid except Pro or Gly
  SITE (987)..(987): Xaa can be any amino acid except Pro or Gly
  SITE (988)..(988): Xaa can be any amino acid except Pro or Gly
  SITE (990)..(990): Xaa can be any amino acid
  SITE (991)..(991): Xaa can be any amino acid
  SITE (992)..(992): Xaa can be any amino acid
  SITE (994)..(994): Xaa can be any amino acid except Pro or Gly
  SITE (995)..(995): Xaa can be any amino acid except Pro or Gly
  SITE (996)..(996): Xaa can be any amino acid except Pro or Gly
  SITE (997)..(997): Xaa can be any amino acid except Pro or Gly
  SITE (999)..(999): Xaa can be any amino acid
  SITE (1000)..(1000): Xaa can be any amino acid
  SITE (1001)..(1001): Xaa can be any amino acid
  SITE (1003)..(1003): Xaa can be any amino acid except Pro or Gly
  SITE (1004)..(1004): Xaa can be any amino acid except Pro or Gly
  SITE (1005)..(1005): Xaa can be any amino acid except Pro or Gly
  SITE (1006)..(1006): Xaa can be any amino acid except Pro or Gly
  SITE (1008)..(1008): Xaa can be any amino acid
  SITE (1009)..(1009): Xaa can be any amino acid
  SITE (1010)..(1010): Xaa can be any amino acid
  SITE (1012)..(1012): Xaa can be any amino acid except Pro or Gly
  SITE (1013)..(1013): Xaa can be any amino acid except Pro or Gly
  SITE (1014)..(1014): Xaa can be any amino acid except Pro or Gly
  SITE (1015)..(1015): Xaa can be any amino acid except Pro or Gly
  SITE (1017)..(1017): Xaa can be any amino acid
  SITE (1018)..(1018): Xaa can be any amino acid
  SITE (1019)..(1019): Xaa can be any amino acid
  SITE (1021)..(1021): Xaa can be any amino acid except Pro or Gly
  SITE (1022)..(1022): Xaa can be any amino acid except Pro or Gly
  SITE (1023)..(1023): Xaa can be any amino acid except Pro or Gly
  SITE (1024)..(1024): Xaa can be any amino acid except Pro or Gly
  SITE (1026)..(1026): Xaa can be any amino acid
  SITE (1027)..(1027): Xaa can be any amino acid
  SITE (1028)..(1028): Xaa can be any amino acid
  SITE (1030)..(1030): Xaa can be any amino acid except Pro or Gly
  SITE (1031)..(1031): Xaa can be any amino acid except Pro or Gly
  SITE (1032)..(1032): Xaa can be any amino acid except Pro or Gly
  SITE (1033)..(1033): Xaa can be any amino acid except Pro or Gly
  SITE (1035)..(1035): Xaa can be any amino acid
  SITE (1036)..(1036): Xaa can be any amino acid
  SITE (1037)..(1037): Xaa can be any amino acid
  SITE (1039)..(1039): Xaa can be any amino acid except Pro or Gly
  SITE (1040)..(1040): Xaa can be any amino acid except Pro or Gly
  SITE (1041)..(1041): Xaa can be any amino acid except Pro or Gly
  SITE (1042)..(1042): Xaa can be any amino acid except Pro or Gly
  SITE (1044)..(1044): Xaa can be any amino acid
  SITE (1045)..(1045): Xaa can be any amino acid
  SITE (1046)..(1046): Xaa can be any amino acid
  SITE (1048)..(1048): Xaa can be any amino acid except Pro or Gly
  SITE (1049)..(1049): Xaa can be any amino acid except Pro or Gly
  SITE (1050)..(1050): Xaa can be any amino acid except Pro or Gly
  SITE (1051)..(1051): Xaa can be any amino acid except Pro or Gly
  SITE (1053)..(1053): Xaa can be any amino acid
  SITE (1054)..(1054): Xaa can be any amino acid
  SITE (1055)..(1055): Xaa can be any amino acid
  SITE (1057)..(1057): Xaa can be any amino acid except Pro or Gly
  SITE (1058)..(1058): Xaa can be any amino acid except Pro or Gly
  SITE (1059)..(1059): Xaa can be any amino acid except Pro or Gly
  SITE (1060)..(1060): Xaa can be any amino acid except Pro or Gly
  SITE (1062)..(1062): Xaa can be any amino acid
  SITE (1063)..(1063): Xaa can be any amino acid
  SITE (1064)..(1064): Xaa can be any amino acid
  SITE (1066)..(1066): Xaa can be any amino acid except Pro or Gly
  SITE (1067)..(1067): Xaa can be any amino acid except Pro or Gly
  SITE (1068)..(1068): Xaa can be any amino acid except Pro or Gly
  SITE (1069)..(1069): Xaa can be any amino acid except Pro or Gly
  SITE (1071)..(1071): Xaa can be any amino acid
  SITE (1072)..(1072): Xaa can be any amino acid
  SITE (1073)..(1073): Xaa can be any amino acid
  SITE (1075)..(1075): Xaa can be any amino acid except Pro or Gly
  SITE (1076)..(1076): Xaa can be any amino acid except Pro or Gly
  SITE (1077)..(1077): Xaa can be any amino acid except Pro or Gly
  SITE (1078)..(1078): Xaa can be any amino acid except Pro or Gly
  SITE (1080)..(1080): Xaa can be any amino acid
  SITE (1081)..(1081): Xaa can be any amino acid
  SITE (1082)..(1082): Xaa can be any amino acid
  SITE (1084)..(1084): Xaa can be any amino acid except Pro or Gly
  SITE (1085)..(1085): Xaa can be any amino acid except Pro or Gly
  SITE (1086)..(1086): Xaa can be any amino acid except Pro or Gly
  SITE (1087)..(1087): Xaa can be any amino acid except Pro or Gly
  SITE (1089)..(1089): Xaa can be any amino acid
  SITE (1090)..(1090): Xaa can be any amino acid
  SITE (1091)..(1091): Xaa can be any amino acid
  SITE (1093)..(1093): Xaa can be any amino acid except Pro or Gly
  SITE (1094)..(1094): Xaa can be any amino acid except Pro or Gly
  SITE (1095)..(1095): Xaa can be any amino acid except Pro or Gly
  SITE (1096)..(1096): Xaa can be any amino acid except Pro or Gly
  SITE (1098)..(1098): Xaa can be any amino acid
  SITE (1099)..(1099): Xaa can be any amino acid
  SITE (1100)..(1100): Xaa can be any amino acid
  SITE (1102)..(1102): Xaa can be any amino acid except Pro or Gly
  SITE (1103)..(1103): Xaa can be any amino acid except Pro or Gly
  SITE (1104)..(1104): Xaa can be any amino acid except Pro or Gly
  SITE (1105)..(1105): Xaa can be any amino acid except Pro or Gly
  SITE (1107)..(1107): Xaa can be any amino acid
  SITE (1108)..(1108): Xaa can be any amino acid
  SITE (1109)..(1109): Xaa can be any amino acid
  SITE (1111)..(1111): Xaa can be any amino acid except Pro or Gly
  SITE (1112)..(1112): Xaa can be any amino acid except Pro or Gly
  SITE (1113)..(1113): Xaa can be any amino acid except Pro or Gly
  SITE (1114)..(1114): Xaa can be any amino acid except Pro or Gly
  SITE (1116)..(1116): Xaa can be any amino acid
  SITE (1117)..(1117): Xaa can be any amino acid
  SITE (1118)..(1118): Xaa can be any amino acid
  SITE (1120)..(1120): Xaa can be any amino acid except Pro or Gly
  SITE (1121)..(1121): Xaa can be any amino acid except Pro or Gly
  SITE (1122)..(1122): Xaa can be any amino acid except Pro or Gly
  SITE (1123)..(1123): Xaa can be any amino acid except Pro or Gly
  SITE (1125)..(1125): Xaa can be any amino acid
  SITE (1126)..(1126): Xaa can be any amino acid
  SITE (1127)..(1127): Xaa can be any amino acid
  SITE (1129)..(1129): Xaa can be any amino acid except Pro or Gly
  SITE (1130)..(1130): Xaa can be any amino acid except Pro or Gly
  SITE (1131)..(1131): Xaa can be any amino acid except Pro or Gly
  SITE (1132)..(1132): Xaa can be any amino acid except Pro or Gly
  SITE (1134)..(1134): Xaa can be any amino acid
  SITE (1135)..(1135): Xaa can be any amino acid
  SITE (1136)..(1136): Xaa can be any amino acid
  SITE (1138)..(1138): Xaa can be any amino acid except Pro or Gly
  SITE (1139)..(1139): Xaa can be any amino acid except Pro or Gly
  SITE (1140)..(1140): Xaa can be any amino acid except Pro or Gly
  SITE (1141)..(1141): Xaa can be any amino acid except Pro or Gly
  SITE (1143)..(1143): Xaa can be any amino acid
  SITE (1144)..(1144): Xaa can be any amino acid
  SITE (1145)..(1145): Xaa can be any amino acid
  SITE (1147)..(1147): Xaa can be any amino acid except Pro or Gly
  SITE (1148)..(1148): Xaa can be any amino acid except Pro or Gly
  SITE (1149)..(1149): Xaa can be any amino acid except Pro or Gly
  SITE (1150)..(1150): Xaa can be any amino acid except Pro or Gly
  SITE (1152)..(1152): Xaa can be any amino acid
  SITE (1153)..(1153): Xaa can be any amino acid
  SITE (1154)..(1154): Xaa can be any amino acid
  SITE (1156)..(1156): Xaa can be any amino acid except Pro or Gly
  SITE (1157)..(1157): Xaa can be any amino acid except Pro or Gly
  SITE (1158)..(1158): Xaa can be any amino acid except Pro or Gly
  SITE (1159)..(1159): Xaa can be any amino acid except Pro or Gly
  SITE (1161)..(1161): Xaa can be any amino acid
  SITE (1162)..(1162): Xaa can be any amino acid
  SITE (1163)..(1163): Xaa can be any amino acid
  SITE (1165)..(1165): Xaa can be any amino acid except Pro or Gly
  SITE (1166)..(1166): Xaa can be any amino acid except Pro or Gly
  SITE (1167)..(1167): Xaa can be any amino acid except Pro or Gly
  SITE (1168)..(1168): Xaa can be any amino acid except Pro or Gly
  SITE (1170)..(1170): Xaa can be any amino acid
  SITE (1171)..(1171): Xaa can be any amino acid
  SITE (1172)..(1172): Xaa can be any amino acid
  SITE (1174)..(1174): Xaa can be any amino acid except Pro or Gly
  SITE (1175)..(1175): Xaa can be any amino acid except Pro or Gly
  SITE (1176)..(1176): Xaa can be any amino acid except Pro or Gly
  SITE (1177)..(1177): Xaa can be any amino acid except Pro or Gly
  SITE (1179)..(1179): Xaa can be any amino acid
  SITE (1180)..(1180): Xaa can be any amino acid
  SITE (1181)..(1181): Xaa can be any amino acid
  SITE (1183)..(1183): Xaa can be any amino acid except Pro or Gly
  SITE (1184)..(1184): Xaa can be any amino acid except Pro or Gly
  SITE (1185)..(1185): Xaa can be any amino acid except Pro or Gly
  SITE (1186)..(1186): Xaa can be any amino acid except Pro or Gly
  SITE (1188)..(1188): Xaa can be any amino acid
  SITE (1189)..(1189): Xaa can be any amino acid
  SITE (1190)..(1190): Xaa can be any amino acid
  SITE (1192)..(1192): Xaa can be any amino acid except Pro or Gly
  SITE (1193)..(1193): Xaa can be any amino acid except Pro or Gly
  SITE (1194)..(1194): Xaa can be any amino acid except Pro or Gly
  SITE (1195)..(1195): Xaa can be any amino acid except Pro or Gly
  SITE (1197)..(1197): Xaa can be any amino acid
  SITE (1198)..(1198): Xaa can be any amino acid
  SITE (1199)..(1199): Xaa can be any amino acid
  SITE (1201)..(1201): Xaa can be any amino acid except Pro or Gly
  SITE (1202)..(1202): Xaa can be any amino acid except Pro or Gly
  SITE (1203)..(1203): Xaa can be any amino acid except Pro or Gly
  SITE (1204)..(1204): Xaa can be any amino acid except Pro or Gly
  SITE (1206)..(1206): Xaa can be any amino acid
  SITE (1207)..(1207): Xaa can be any amino acid
  SITE (1208)..(1208): Xaa can be any amino acid
  SITE (1210)..(1210): Xaa can be any amino acid except Pro or Gly
  SITE (1211)..(1211): Xaa can be any amino acid except Pro or Gly
  SITE (1212)..(1212): Xaa can be any amino acid except Pro or Gly
  SITE (1213)..(1213): Xaa can be any amino acid except Pro or Gly
  SITE (1215)..(1215): Xaa can be any amino acid
  SITE (1216)..(1216): Xaa can be any amino acid
  SITE (1217)..(1217): Xaa can be any amino acid
  SITE (1219)..(1219): Xaa can be any amino acid except Pro or Gly
  SITE (1220)..(1220): Xaa can be any amino acid except Pro or Gly
  SITE (1221)..(1221): Xaa can be any amino acid except Pro or Gly
  SITE (1222)..(1222): Xaa can be any amino acid except Pro or Gly
  SITE (1224)..(1224): Xaa can be any amino acid
  SITE (1225)..(1225): Xaa can be any amino acid
  SITE (1226)..(1226): Xaa can be any amino acid
  SITE (1228)..(1228): Xaa can be any amino acid except Pro or Gly
  SITE (1229)..(1229): Xaa can be any amino acid except Pro or Gly
  SITE (1230)..(1230): Xaa can be any amino acid except Pro or Gly
  SITE (1231)..(1231): Xaa can be any amino acid except Pro or Gly
  SITE (1233)..(1233): Xaa can be any amino acid
  SITE (1234)..(1234): Xaa can be any amino acid
  SITE (1235)..(1235): Xaa can be any amino acid
  SITE (1237)..(1237): Xaa can be any amino acid except Pro or Gly
  SITE (1238)..(1238): Xaa can be any amino acid except Pro or Gly
  SITE (1239)..(1239): Xaa can be any amino acid except Pro or Gly
  SITE (1240)..(1240): Xaa can be any amino acid except Pro or Gly
  SITE (1242)..(1242): Xaa can be any amino acid
  SITE (1243)..(1243): Xaa can be any amino acid
  SITE (1244)..(1244): Xaa can be any amino acid
  SITE (1246)..(1246): Xaa can be any amino acid except Pro or Gly
  SITE (1247)..(1247): Xaa can be any amino acid except Pro or Gly
  SITE (1248)..(1248): Xaa can be any amino acid except Pro or Gly
  SITE (1249)..(1249): Xaa can be any amino acid except Pro or Gly
  SITE (1251)..(1251): Xaa can be any amino acid
  SITE (1252)..(1252): Xaa can be any amino acid
  SITE (1253)..(1253): Xaa can be any amino acid
  SITE (1255)..(1255): Xaa can be any amino acid except Pro or Gly
  SITE (1256)..(1256): Xaa can be any amino acid except Pro or Gly
  SITE (1257)..(1257): Xaa can be any amino acid except Pro or Gly
  SITE (1258)..(1258): Xaa can be any amino acid except Pro or Gly
  SITE (1260)..(1260): Xaa can be any amino acid
  SITE (1261)..(1261): Xaa can be any amino acid
  SITE (1262)..(1262): Xaa can be any amino acid
  SITE (1264)..(1264): Xaa can be any amino acid except Pro or Gly
  SITE (1265)..(1265): Xaa can be any amino acid except Pro or Gly
  SITE (1266)..(1266): Xaa can be any amino acid except Pro or Gly
  SITE (1267)..(1267): Xaa can be any amino acid except Pro or Gly
  SITE (1269)..(1269): Xaa can be any amino acid
  SITE (1270)..(1270): Xaa can be any amino acid
  SITE (1271)..(1271): Xaa can be any amino acid
  SITE (1273)..(1273): Xaa can be any amino acid except Pro or Gly
  SITE (1274)..(1274): Xaa can be any amino acid except Pro or Gly
  SITE (1275)..(1275): Xaa can be any amino acid except Pro or Gly
  SITE (1276)..(1276): Xaa can be any amino acid except Pro or Gly
  SITE (1278)..(1278): Xaa can be any amino acid
  SITE (1279)..(1279): Xaa can be any amino acid
  SITE (1280)..(1280): Xaa can be any amino acid
  SITE (1282)..(1282): Xaa can be any amino acid except Pro or Gly
  SITE (1283)..(1283): Xaa can be any amino acid except Pro or Gly
  SITE (1284)..(1284): Xaa can be any amino acid except Pro or Gly
  SITE (1285)..(1285): Xaa can be any amino acid except Pro or Gly
  SITE (1287)..(1287): Xaa can be any amino acid
  SITE (1288)..(1288): Xaa can be any amino acid
  SITE (1289)..(1289): Xaa can be any amino acid
  SITE (1291)..(1291): Xaa can be any amino acid except Pro or Gly
  SITE (1292)..(1292): Xaa can be any amino acid except Pro or Gly
  SITE (1293)..(1293): Xaa can be any amino acid except Pro or Gly
  SITE (1294)..(1294): Xaa can be any amino acid except Pro or Gly
  SITE (1296)..(1296): Xaa can be any amino acid
  SITE (1297)..(1297): Xaa can be any amino acid
  SITE (1298)..(1298): Xaa can be any amino acid
  SITE (1300)..(1300): Xaa can be any amino acid except Pro or Gly
  SITE (1301)..(1301): Xaa can be any amino acid except Pro or Gly
  SITE (1302)..(1302): Xaa can be any amino acid except Pro or Gly
  SITE (1303)..(1303): Xaa can be any amino acid except Pro or Gly
  SITE (1305)..(1305): Xaa can be any amino acid
  SITE (1306)..(1306): Xaa can be any amino acid
  SITE (1307)..(1307): Xaa can be any amino acid
  SITE (1309)..(1309): Xaa can be any amino acid except Pro or Gly
  SITE (1310)..(1310): Xaa can be any amino acid except Pro or Gly
  SITE (1311)..(1311): Xaa can be any amino acid except Pro or Gly
  SITE (1312)..(1312): Xaa can be any amino acid except Pro or Gly
  SITE (1314)..(1314): Xaa can be any amino acid
  SITE (1315)..(1315): Xaa can be any amino acid
  SITE (1316)..(1316): Xaa can be any amino acid
  SITE (1318)..(1318): Xaa can be any amino acid except Pro or Gly
  SITE (1319)..(1319): Xaa can be any amino acid except Pro or Gly
  SITE (1320)..(1320): Xaa can be any amino acid except Pro or Gly
  SITE (1321)..(1321): Xaa can be any amino acid except Pro or Gly
  SITE (1323)..(1323): Xaa can be any amino acid
  SITE (1324)..(1324): Xaa can be any amino acid
  SITE (1325)..(1325): Xaa can be any amino acid
  SITE (1327)..(1327): Xaa can be any amino acid except Pro or Gly
  SITE (1328)..(1328): Xaa can be any amino acid except Pro or Gly
  SITE (1329)..(1329): Xaa can be any amino acid except Pro or Gly
  SITE (1330)..(1330): Xaa can be any amino acid except Pro or Gly
  SITE (1332)..(1332): Xaa can be any amino acid
  SITE (1333)..(1333): Xaa can be any amino acid
  SITE (1334)..(1334): Xaa can be any amino acid
  SITE (1336)..(1336): Xaa can be any amino acid except Pro or Gly
  SITE (1337)..(1337): Xaa can be any amino acid except Pro or Gly
  SITE (1338)..(1338): Xaa can be any amino acid except Pro or Gly
  SITE (1339)..(1339): Xaa can be any amino acid except Pro or Gly
  SITE (1341)..(1341): Xaa can be any amino acid
  SITE (1342)..(1342): Xaa can be any amino acid
  SITE (1343)..(1343): Xaa can be any amino acid
  SITE (1345)..(1345): Xaa can be any amino acid except Pro or Gly
  SITE (1346)..(1346): Xaa can be any amino acid except Pro or Gly
  SITE (1347)..(1347): Xaa can be any amino acid except Pro or Gly
  SITE (1348)..(1348): Xaa can be any amino acid except Pro or Gly
  SITE (1350)..(1350): Xaa can be any amino acid
  SITE (1351)..(1351): Xaa can be any amino acid
  SITE (1352)..(1352): Xaa can be any amino acid
  SITE (1354)..(1354): Xaa can be any amino acid except Pro or Gly
  SITE (1355)..(1355): Xaa can be any amino acid except Pro or Gly
  SITE (1356)..(1356): Xaa can be any amino acid except Pro or Gly
  SITE (1357)..(1357): Xaa can be any amino acid except Pro or Gly
  SITE (1359)..(1359): Xaa can be any amino acid
  SITE (1360)..(1360): Xaa can be any amino acid
  SITE (1361)..(1361): Xaa can be any amino acid
  SITE (1363)..(1363): Xaa can be any amino acid except Pro or Gly
  SITE (1364)..(1364): Xaa can be any amino acid except Pro or Gly
  SITE (1365)..(1365): Xaa can be any amino acid except Pro or Gly
  SITE (1366)..(1366): Xaa can be any amino acid except Pro or Gly
  SITE (1368)..(1368): Xaa can be any amino acid
  SITE (1369)..(1369): Xaa can be any amino acid
  SITE (1370)..(1370): Xaa can be any amino acid
  SITE (1372)..(1372): Xaa can be any amino acid except Pro or Gly
  SITE (1373)..(1373): Xaa can be any amino acid except Pro or Gly
  SITE (1374)..(1374): Xaa can be any amino acid except Pro or Gly
  SITE (1375)..(1375): Xaa can be any amino acid except Pro or Gly
  SITE (1377)..(1377): Xaa can be any amino acid
  SITE (1378)..(1378): Xaa can be any amino acid
  SITE (1379)..(1379): Xaa can be any amino acid
  SITE (1381)..(1381): Xaa can be any amino acid except Pro or Gly
  SITE (1382)..(1382): Xaa can be any amino acid except Pro or Gly
  SITE (1383)..(1383): Xaa can be any amino acid except Pro or Gly
  SITE (1384)..(1384): Xaa can be any amino acid except Pro or Gly
  SITE (1386)..(1386): Xaa can be any amino acid
  SITE (1387)..(1387): Xaa can be any amino acid
  SITE (1388)..(1388): Xaa can be any amino acid
  SITE (1390)..(1390): Xaa can be any amino acid except Pro or Gly
  SITE (1391)..(1391): Xaa can be any amino acid except Pro or Gly
  SITE (1392)..(1392): Xaa can be any amino acid except Pro or Gly
  SITE (1393)..(1393): Xaa can be any amino acid except Pro or Gly
  SITE (1395)..(1395): Xaa can be any amino acid
  SITE (1396)..(1396): Xaa can be any amino acid
  SITE (1397)..(1397): Xaa can be any amino acid
  SITE (1399)..(1399): Xaa can be any amino acid except Pro or Gly
  SITE (1400)..(1400): Xaa can be any amino acid except Pro or Gly
  SITE (1401)..(1401): Xaa can be any amino acid except Pro or Gly
  SITE (1402)..(1402): Xaa can be any amino acid except Pro or Gly
  SITE (1404)..(1404): Xaa can be any amino acid
  SITE (1405)..(1405): Xaa can be any amino acid
  SITE (1406)..(1406): Xaa can be any amino acid
  SITE (1408)..(1408): Xaa can be any amino acid except Pro or Gly
  SITE (1409)..(1409): Xaa can be any amino acid except Pro or Gly
  SITE (1410)..(1410): Xaa can be any amino acid except Pro or Gly
  SITE (1411)..(1411): Xaa can be any amino acid except Pro or Gly
  SITE (1413)..(1413): Xaa can be any amino acid
  SITE (1414)..(1414): Xaa can be any amino acid
  SITE (1415)..(1415): Xaa can be any amino acid
  SITE (1417)..(1417): Xaa can be any amino acid except Pro or Gly
  SITE (1418)..(1418): Xaa can be any amino acid except Pro or Gly
  SITE (1419)..(1419): Xaa can be any amino acid except Pro or Gly
  SITE (1420)..(1420): Xaa can be any amino acid except Pro or Gly
  SITE (1422)..(1422): Xaa can be any amino acid
  SITE (1423)..(1423): Xaa can be any amino acid
  SITE (1424)..(1424): Xaa can be any amino acid
  SITE (1426)..(1426): Xaa can be any amino acid except Pro or Gly
  SITE (1427)..(1427): Xaa can be any amino acid except Pro or Gly
  SITE (1428)..(1428): Xaa can be any amino acid except Pro or Gly
  SITE (1429)..(1429): Xaa can be any amino acid except Pro or Gly
  SITE (1431)..(1431): Xaa can be any amino acid
  SITE (1432)..(1432): Xaa can be any amino acid
  SITE (1433)..(1433): Xaa can be any amino acid
  SITE (1435)..(1435): Xaa can be any amino acid except Pro or Gly
  SITE (1436)..(1436): Xaa can be any amino acid except Pro or Gly
  SITE (1437)..(1437): Xaa can be any amino acid except Pro or Gly
  SITE (1438)..(1438): Xaa can be any amino acid except Pro or Gly
  SITE (1440)..(1440): Xaa can be any amino acid
XXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGXXXPXXXXGX

SEQ ID NO: 58 - protein, 960 aa, Artificial Sequence
  elastin-like polypeptide
  SITE (1)..(1): Xaa can be any amino acid
  SITE (2)..(2): Xaa can be any amino acid
  SITE (4)..(4): Xaa can be any amino acid except Pro or Gly
  SITE (6)..(6): Xaa can be any amino acid
  SITE (7)..(7): Xaa can be any amino acid
  SITE (8)..(8): Xaa can be any amino acid
  SITE (10)..(10): Xaa can be any amino acid except Pro or Gly
  SITE (12)..(12): Xaa can be any amino acid
  SITE (13)..(13): Xaa can be any amino acid
  SITE (14)..(14): Xaa can be any amino acid
  SITE (16)..(16): Xaa can be any amino acid except Pro or Gly
  SITE (18)..(18): Xaa can be any amino acid
  SITE (19)..(19): Xaa can be any amino acid
  SITE (20)..(20): Xaa can be any amino acid
  SITE (22)..(22): Xaa can be any amino acid except Pro or Gly
  SITE (24)..(24): Xaa can be any amino acid
  SITE (25)..(25): Xaa can be any amino acid
  SITE (26)..(26): Xaa can be any amino acid
  SITE (28)..(28): Xaa can be any amino acid except Pro or Gly
  SITE (30)..(30): Xaa can be any amino acid
  SITE (31)..(31): Xaa can be any amino acid
  SITE (32)..(32): Xaa can be any amino acid
  SITE (34)..(34): Xaa can be any amino acid except Pro or Gly
  SITE (36)..(36): Xaa can be any amino acid
  SITE (37)..(37): Xaa can be any amino acid
  SITE (38)..(38): Xaa can be any amino acid
  SITE (40)..(40): Xaa can be any amino acid except Pro or Gly
  SITE (42)..(42): Xaa can be any amino acid
  SITE (43)..(43): Xaa can be any amino acid
  SITE (44)..(44): Xaa can be any amino acid
  SITE (46)..(46): Xaa can be any amino acid except Pro or Gly
  SITE (48)..(48): Xaa can be any amino acid
  SITE (49)..(49): Xaa can be any amino acid
  SITE (50)..(50): Xaa can be any amino acid
  SITE (52)..(52): Xaa can be any amino acid except Pro or Gly
  SITE (54)..(54): Xaa can be any amino acid
  SITE (55)..(55): Xaa can be any amino acid
  SITE (56)..(56): Xaa can be any amino acid
  SITE (58)..(58): Xaa can be any amino acid except Pro or Gly
  SITE (60)..(60): Xaa can be any amino acid
  SITE (61)..(960): May be present or absent in groups of the repeat unit Xaa Xaa Pro Xaa Gly Xaa Xaa
  SITE (61)..(61): Xaa can be any amino acid
  SITE (62)..(62): Xaa can be any amino acid
  SITE (64)..(64): Xaa can be any amino acid except Pro or Gly
  SITE (66)..(66): Xaa can be any amino acid
  SITE (67)..(67): Xaa can be any amino acid
  SITE (68)..(68): Xaa can be any amino acid
  SITE (70)..(70): Xaa can be any amino acid except Pro or Gly
  SITE (72)..(72): Xaa can be any amino acid
  SITE (73)..(73): Xaa can be any amino acid
  SITE (74)..(74): Xaa can be any amino acid
  SITE (76)..(76): Xaa can be any amino acid except Pro or Gly
  SITE (78)..(78): Xaa can be any amino acid
  SITE (79)..(79): Xaa can be any amino acid
  SITE (80)..(80): Xaa can be any amino acid
  SITE (82)..(82): Xaa can be any amino acid except Pro or Gly
  SITE (84)..(84): Xaa can be any amino acid
  SITE (85)..(85): Xaa can be any amino acid
  SITE (86)..(86): Xaa can be any amino acid
  SITE (88)..(88): Xaa can be any amino acid except Pro or Gly
  SITE (90)..(90): Xaa can be any amino acid
  SITE (91)..(91): Xaa can be any amino acid
  SITE (92)..(92): Xaa can be any amino acid
  SITE (94)..(94): Xaa can be any amino acid except Pro or Gly
  SITE (96)..(96): Xaa can be any amino acid
  SITE (97)..(97): Xaa can be any amino acid
  SITE (98)..(98): Xaa can be any amino acid
  SITE (100)..(100): Xaa can be any amino acid except Pro or Gly
  SITE (102)..(102): Xaa can be any amino acid
  SITE (103)..(103): Xaa can be any amino acid
  SITE (104)..(104): Xaa can be any amino acid
  SITE (106)..(106): Xaa can be any amino acid except Pro or Gly
  SITE (108)..(108): Xaa can be any amino acid
  SITE (109)..(109): Xaa can be any amino acid
  SITE (110)..(110): Xaa can be any amino acid
  SITE (112)..(112): Xaa can be any amino acid except Pro or Gly
  SITE (114)..(114): Xaa can be any amino acid
  SITE (115)..(115): Xaa can be any amino acid
  SITE (116)..(116): Xaa can be any amino acid
  SITE (118)..(118): Xaa can be any amino acid except Pro or Gly
  SITE (120)..(120): Xaa can be any amino acid
  SITE (121)..(121): Xaa can be any amino acid
  SITE (122)..(122): Xaa can be any amino acid
  SITE (124)..(124): Xaa can be any amino acid except Pro or Gly
  SITE (126)..(126): Xaa can be any amino acid
  SITE (127)..(127): Xaa can be any amino acid
  SITE (128)..(128): Xaa can be any amino acid
  SITE (130)..(130): Xaa can be any amino acid except Pro or Gly
  SITE (132)..(132): Xaa can be any amino acid
  SITE (133)..(133): Xaa can be any amino acid
  SITE (134)..(134): Xaa can be any amino acid
  SITE (136)..(136): Xaa can be any amino acid except Pro or Gly
  SITE (138)..(138): Xaa can be any amino acid
  SITE (139)..(139): Xaa can be any amino acid
  SITE (140)..(140): Xaa can be any amino acid
  SITE (142)..(142): Xaa can be any amino acid except Pro or Gly
  SITE (144)..(144): Xaa can be any amino acid
  SITE (145)..(145): Xaa can be any amino acid
  SITE (146)..(146): Xaa can be any amino acid
  SITE (148)..(148): Xaa can be any amino acid except Pro or Gly
  SITE (150)..(150): Xaa can be any amino acid
  SITE (151)..(151): Xaa can be any amino acid
  SITE (152)..(152): Xaa can be any amino acid
  SITE (154)..(154): Xaa can be any amino acid except Pro or Gly
  SITE (156)..(156): Xaa can be any amino acid
  SITE (157)..(157): Xaa can be any amino acid
  SITE (158)..(158): Xaa can be any amino acid
  SITE (160)..(160): Xaa can be any amino acid except Pro or Gly
  SITE (162)..(162): Xaa can be any amino acid
  SITE (163)..(163): Xaa can be any amino acid
  SITE (164)..(164): Xaa can be any amino acid
  SITE (166)..(166): Xaa can be any amino acid except Pro or Gly
  SITE (168)..(168): Xaa can be any amino acid
  SITE (169)..(169): Xaa can be any amino acid
  SITE (170)..(170): Xaa can be any amino acid
  SITE (172)..(172): Xaa can be any amino acid except Pro or Gly
  SITE (174)..(174): Xaa can be any amino acid
  SITE (175)..(175): Xaa can be any amino acid
  SITE (176)..(176): Xaa can be any amino acid
  SITE (178)..(178): Xaa can be any amino acid except Pro or Gly
  SITE (180)..(180): Xaa can be any amino acid
  SITE (181)..(181): Xaa can be any amino acid
  SITE (182)..(182): Xaa can be any amino acid
  SITE (184)..(184): Xaa can be any amino acid except Pro or Gly
  SITE (186)..(186): Xaa can be any amino acid
  SITE (187)..(187): Xaa can be any amino acid
  SITE (188)..(188): Xaa can be any amino acid
  SITE (190)..(190): Xaa can be any amino acid except Pro or Gly
  SITE (192)..(192): Xaa can be any amino acid
  SITE (193)..(193): Xaa can be any amino acid
  SITE (194)..(194): Xaa can be any amino acid
  SITE (196)..(196): Xaa can be any amino acid except Pro or Gly
  SITE (198)..(198): Xaa can be any amino acid
  SITE (199)..(199): Xaa can be any amino acid
  SITE (200)..(200): Xaa can be any amino acid
  SITE (202)..(202): Xaa can be any amino acid except Pro or Gly
  SITE (204)..(204): Xaa can be any amino acid
  SITE (205)..(205): Xaa can be any amino acid
  SITE (206)..(206): Xaa can be any amino acid
  SITE (208)..(208): Xaa can be any amino acid except Pro or Gly
  SITE (210)..(210): Xaa can be any amino acid
  SITE (211)..(211): Xaa can be any amino acid
  SITE (212)..(212): Xaa can be any amino acid
  SITE (214)..(214): Xaa can be any amino acid except Pro or Gly
  SITE (216)..(216): Xaa can be any amino acid
  SITE (217)..(217): Xaa can be any amino acid
  SITE (218)..(218): Xaa can be any amino acid
  SITE (220)..(220): Xaa can be any amino acid except Pro or Gly
  SITE (222)..(222): Xaa can be any amino acid
  SITE (223)..(223): Xaa can be any amino acid
  SITE (224)..(224): Xaa can be any amino acid
  SITE (226)..(226): Xaa can be any amino acid except Pro or Gly
  SITE (228)..(228): Xaa can be any amino acid
  SITE (229)..(229): Xaa can be any amino acid
  SITE (230)..(230): Xaa can be any amino acid
  SITE (232)..(232): Xaa can be any amino acid except Pro or Gly
  SITE (234)..(234): Xaa can be any amino acid
  SITE (235)..(235): Xaa can be any amino acid
  SITE (236)..(236): Xaa can be any amino acid
  SITE (238)..(238): Xaa can be any amino acid except Pro or Gly
  SITE (240)..(240): Xaa can be any amino acid
  SITE (241)..(241): Xaa can be any amino acid
  SITE (242)..(242): Xaa can be any amino acid
  SITE (244)..(244): Xaa can be any amino acid except Pro or Gly
  SITE (246)..(246): Xaa can be any amino acid
  SITE (247)..(247): Xaa can be any amino acid
  SITE (248)..(248): Xaa can be any amino acid
  SITE (250)..(250): Xaa can be any amino acid except Pro or Gly
  SITE (252)..(252): Xaa can be any amino acid
  SITE (253)..(253): Xaa can be any amino acid
  SITE (254)..(254): Xaa can be any amino acid
  SITE (256)..(256): Xaa can be any amino acid except Pro or Gly
  SITE (258)..(258): Xaa can be any amino acid
  SITE (259)..(259): Xaa can be any amino acid
  SITE (260)..(260): Xaa can be any amino acid
  SITE (262)..(262): Xaa can be any amino acid except Pro or Gly
  SITE (264)..(264): Xaa can be any amino acid
  SITE (265)..(265): Xaa can be any amino acid
  SITE (266)..(266): Xaa can be any amino acid
  SITE (268)..(268): Xaa can be any amino acid except Pro or Gly
  SITE (270)..(270): Xaa can be any amino acid
  SITE (271)..(271): Xaa can be any amino acid
  SITE (272)..(272): Xaa can be any amino acid
  SITE (274)..(274): Xaa can be any amino acid except Pro or Gly
  SITE (276)..(276): Xaa can be any amino acid
  SITE (277)..(277): Xaa can be any amino acid
  SITE (278)..(278): Xaa can be any amino acid
  SITE (280)..(280): Xaa can be any amino acid except Pro or Gly
  SITE (282)..(282): Xaa can be any amino acid
  SITE (283)..(283): Xaa can be any amino acid
  SITE (284)..(284): Xaa can be any amino acid
  SITE (286)..(286): Xaa can be any amino acid except Pro or Gly
  SITE (288)..(288): Xaa can be any amino acid
  SITE (289)..(289): Xaa can be any amino acid
  SITE (290)..(290): Xaa can be any amino acid
  SITE (292)..(292): Xaa can be any amino acid except Pro or Gly
  SITE (294)..(294): Xaa can be any amino acid
  SITE (295)..(295): Xaa can be any amino acid
  SITE (296)..(296): Xaa can be any amino acid
  SITE (298)..(298): Xaa can be any amino acid except Pro or Gly
  SITE (300)..(300): Xaa can be any amino acid
  SITE (301)..(301): Xaa can be any amino acid
  SITE (302)..(302): Xaa can be any amino acid
  SITE (304)..(304): Xaa can be any amino acid except Pro or Gly
  SITE (306)..(306): Xaa can be any amino acid
  SITE (307)..(307): Xaa can be any amino acid
  SITE (308)..(308): Xaa can be any amino acid
  SITE (310)..(310): Xaa can be any amino acid except Pro or Gly
  SITE (312)..(312): Xaa can be any amino acid
  SITE (313)..(313): Xaa can be any amino acid
  SITE (314)..(314): Xaa can be any amino acid
  SITE (316)..(316): Xaa can be any amino acid except Pro or Gly
  SITE (318)..(318): Xaa can be any amino acid
  SITE (319)..(319): Xaa can be any amino acid
  SITE (320)..(320): Xaa can be any amino acid
  SITE (322)..(322): Xaa can be any amino acid except Pro or Gly
  SITE (324)..(324): Xaa can be any amino acid
  SITE (325)..(325): Xaa can be any amino acid
  SITE (326)..(326): Xaa can be any amino acid
  SITE (328)..(328): Xaa can be any amino acid except Pro or Gly
  SITE (330)..(330): Xaa can be any amino acid
  SITE (331)..(331): Xaa can be any amino acid
  SITE (332)..(332): Xaa can be any amino acid
  SITE (334)..(334): Xaa can be any amino acid except Pro or Gly
  SITE (336)..(336): Xaa can be any amino acid
  SITE (337)..(337): Xaa can be any amino acid
  SITE (338)..(338): Xaa can be any amino acid
  SITE (340)..(340): Xaa can be any amino acid except Pro or Gly
  SITE (342)..(342): Xaa can be any amino acid
  SITE (343)..(343): Xaa can be any amino acid
  SITE (344)..(344): Xaa can be any amino acid
  SITE (346)..(346): Xaa can be any amino acid except Pro or Gly
  SITE (348)..(348): Xaa can be any amino acid
  SITE (349)..(349): Xaa can be any amino acid
  SITE (350)..(350): Xaa can be any amino acid
  SITE (352)..(352): Xaa can be any amino acid except Pro or Gly
  SITE (354)..(354): Xaa can be any amino acid
  SITE (355)..(355): Xaa can be any amino acid
  SITE (356)..(356): Xaa can be any amino acid
  SITE (358)..(358): Xaa can be any amino acid except Pro or Gly
  SITE (360)..(360): Xaa can be any amino acid
  SITE (361)..(361): Xaa can be any amino acid
  SITE (362)..(362): Xaa can be any amino acid
  SITE (364)..(364): Xaa can be any amino acid except Pro or Gly
  SITE (366)..(366): Xaa can be any amino acid
  SITE (367)..(367): Xaa can be any amino acid
  SITE (368)..(368): Xaa can be any amino acid
  SITE (370)..(370): Xaa can be any amino acid except Pro or Gly
  SITE (372)..(372): Xaa can be any amino acid
  SITE (373)..(373): Xaa can be any amino acid
  SITE (374)..(374): Xaa can be any amino acid
  SITE (376)..(376): Xaa can be any amino acid except Pro or Gly
  SITE (378)..(378): Xaa can be any amino acid
  SITE (379)..(379): Xaa can be any amino acid
  SITE (380)..(380): Xaa can be any amino acid
  SITE (382)..(382): Xaa can be any amino acid except Pro or Gly
  SITE (384)..(384): Xaa can be any amino acid
  SITE (385)..(385): Xaa can be any amino acid
  SITE (386)..(386): Xaa can be any amino acid
  SITE (388)..(388): Xaa can be any amino acid except Pro or Gly
  SITE (390)..(390): Xaa can be any amino acid
  SITE (391)..(391): Xaa can be any amino acid
  SITE (392)..(392): Xaa can be any amino acid
  SITE (394)..(394): Xaa can be any amino acid except Pro or Gly
  SITE (396)..(396): Xaa can be any amino acid
  SITE (397)..(397): Xaa can be any amino acid
  SITE (398)..(398): Xaa can be any amino acid
  SITE (400)..(400): Xaa can be any amino acid except Pro or Gly
  SITE (402)..(402): Xaa can be any amino acid
  SITE (403)..(403): Xaa can be any amino acid
  SITE (404)..(404): Xaa can be any amino acid
  SITE (406)..(406): Xaa can be any amino acid except Pro or Gly
  SITE (408)..(408): Xaa can be any amino acid
  SITE (409)..(409): Xaa can be any amino acid
  SITE (410)..(410): Xaa can be any amino acid
  SITE (412)..(412): Xaa can be any amino acid except Pro or Gly
  SITE (414)..(414): Xaa can be any amino acid
  SITE (415)..(415): Xaa can be any amino acid
  SITE (416)..(416): Xaa can be any amino acid
  SITE (418)..(418): Xaa can be any amino acid except Pro or Gly
  SITE (420)..(420): Xaa can be any amino acid
  SITE (421)..(421): Xaa can be any amino acid
  SITE (422)..(422): Xaa can be any amino acid
  SITE (424)..(424): Xaa can be any amino acid except Pro or Gly
  SITE (426)..(426): Xaa can be any amino acid
  SITE (427)..(427): Xaa can be any amino acid
  SITE (428)..(428): Xaa can be any amino acid
  SITE (430)..(430): Xaa can be any amino acid except Pro or Gly
  SITE (432)..(432): Xaa can be any amino acid
  SITE (433)..(433): Xaa can be any amino acid
  SITE (434)..(434): Xaa can be any amino acid
  SITE (436)..(436): Xaa can be any amino acid except Pro or Gly
  SITE (438)..(438): Xaa can be any amino acid
  SITE (439)..(439): Xaa can be any amino acid
  SITE (440)..(440): Xaa can be any amino acid
  SITE (442)..(442): Xaa can be any amino acid except Pro or Gly
  SITE (444)..(444): Xaa can be any amino acid
  SITE (445)..(445): Xaa can be any amino acid
  SITE (446)..(446): Xaa can be any amino acid
  SITE (448)..(448): Xaa can be any amino acid except Pro or Gly
  SITE (450)..(450): Xaa can be any amino acid
  SITE (451)..(451): Xaa can be any amino acid
  SITE (452)..(452): Xaa can be any amino acid
  SITE (454)..(454): Xaa can be any amino acid except Pro or Gly
  SITE (456)..(456): Xaa can be any amino acid
  SITE (457)..(457): Xaa can be any amino acid
  SITE (458)..(458): Xaa can be any amino acid
  SITE (460)..(460): Xaa can be any amino acid except Pro or Gly
  SITE (462)..(462): Xaa can be any amino acid
  SITE (463)..(463): Xaa can be any amino acid
  SITE (464)..(464): Xaa can be any amino acid
  SITE (466)..(466): Xaa can be any amino acid except Pro or Gly
  SITE (468)..(468): Xaa can be any amino acid
  SITE (469)..(469): Xaa can be any amino acid
  SITE (470)..(470): Xaa can be any amino acid
  SITE (472)..(472): Xaa can be any amino acid except Pro or Gly
  SITE (474)..(474): Xaa can be any amino acid
  SITE (475)..(475): Xaa can be any amino acid
  SITE (476)..(476): Xaa can be any amino acid
  SITE (478)..(478): Xaa can be any amino acid except Pro or Gly
  SITE (480)..(480): Xaa can be any amino acid
  SITE (481)..(481): Xaa can be any amino acid
  SITE (482)..(482): Xaa can be any amino acid
  SITE (484)..(484): Xaa can be any amino acid except Pro or Gly
  SITE (486)..(486): Xaa can be any amino acid
  SITE (487)..(487): Xaa can be any amino acid
  SITE (488)..(488): Xaa can be any amino acid
  SITE (490)..(490): Xaa can be any amino acid except Pro or Gly
  SITE (492)..(492): Xaa can be any amino acid
  SITE (493)..(493): Xaa can be any amino acid
  SITE (494)..(494): Xaa can be any amino acid
  SITE (496)..(496): Xaa can be any amino acid except Pro or Gly
  SITE (498)..(498): Xaa can be any amino acid
  SITE (499)..(499): Xaa can be any amino acid
  SITE (500)..(500): Xaa can be any amino acid
  SITE (502)..(502): Xaa can be any amino acid except Pro or Gly
  SITE (504)..(504): Xaa can be any amino acid
  SITE (505)..(505): Xaa can be any amino acid
  SITE (506)..(506): Xaa can be any amino acid
  SITE (508)..(508): Xaa can be any amino acid except Pro or Gly
  SITE (510)..(510): Xaa can be any amino acid
  SITE (511)..(511): Xaa can be any amino acid
  SITE (512)..(512): Xaa can be any amino acid
  SITE (514)..(514): Xaa can be any amino acid except Pro or Gly
  SITE (516)..(516): Xaa can be any amino acid
  SITE (517)..(517): Xaa can be any amino acid
  SITE (518)..(518): Xaa can be any amino acid
  SITE (520)..(520): Xaa can be any amino acid except Pro or Gly
  SITE (522)..(522): Xaa can be any amino acid
  SITE (523)..(523): Xaa can be any amino acid
  SITE (524)..(524): Xaa can be any amino acid
  SITE (526)..(526): Xaa can be any amino acid except Pro or Gly
  SITE (528)..(528): Xaa can be any amino acid
  SITE (529)..(529): Xaa can be any amino acid
  SITE (530)..(530): Xaa can be any amino acid
  SITE (532)..(532): Xaa can be any amino acid except Pro or Gly
  SITE (534)..(534): Xaa can be any amino acid
  SITE (535)..(535): Xaa can be any amino acid
  SITE (536)..(536): Xaa can be any amino acid
  SITE (538)..(538): Xaa can be any amino acid except Pro or Gly
  SITE (540)..(540): Xaa can be any amino acid
  SITE (541)..(541): Xaa can be any amino acid
  SITE (542)..(542): Xaa can be any amino acid
  SITE (544)..(544): Xaa can be any amino acid except Pro or Gly
  SITE (546)..(546): Xaa can be any amino acid
  SITE (547)..(547): Xaa can be any amino acid
  SITE (548)..(548): Xaa can be any amino acid
  SITE (550)..(550): Xaa can be any amino acid except Pro or Gly
  SITE (552)..(552): Xaa can be any amino acid
  SITE (553)..(553): Xaa can be any amino acid
  SITE (554)..(554): Xaa can be any amino acid
  SITE (556)..(556): Xaa can be any amino acid except Pro or Gly
  SITE (558)..(558): Xaa can be any amino acid
  SITE (559)..(559): Xaa can be any amino acid
  SITE (560)..(560): Xaa can be any amino acid
  SITE (562)..(562): Xaa can be any amino acid except Pro or Gly
  SITE (564)..(564): Xaa can be any amino acid
  SITE (565)..(565): Xaa can be any amino acid
  SITE (566)..(566): Xaa can be any amino acid
  SITE (568)..(568): Xaa can be any amino acid except Pro or Gly
  SITE (570)..(570): Xaa can be any amino acid
  SITE (571)..(571): Xaa can be any amino acid
  SITE (572)..(572): Xaa can be any amino acid
  SITE (574)..(574): Xaa can be any amino acid except Pro or Gly
  SITE (576)..(576): Xaa can be any amino acid
  SITE (577)..(577): Xaa can be any amino acid
  SITE (578)..(578): Xaa can be any amino acid
  SITE (580)..(580): Xaa can be any amino acid except Pro or Gly
  SITE (582)..(582): Xaa can be any amino acid
  SITE (583)..(583): Xaa can be any amino acid
  SITE (584)..(584): Xaa can be any amino acid
  SITE (586)..(586): Xaa can be any amino acid except Pro or Gly
  SITE (588)..(588): Xaa can be any amino acid
  SITE (589)..(589): Xaa can be any amino acid
  SITE (590)..(590): Xaa can be any amino acid
  SITE (592)..(592): Xaa can be any amino acid except Pro or Gly
  SITE (594)..(594): Xaa can be any amino acid
  SITE (595)..(595): Xaa can be any amino acid
  SITE (596)..(596): Xaa can be any amino acid
  SITE (598)..(598): Xaa can be any amino acid except Pro or Gly
  SITE (600)..(600): Xaa can be any amino acid
  SITE (601)..(601): Xaa can be any amino acid
  SITE (602)..(602): Xaa can be any amino acid
  SITE (604)..(604): Xaa can be any amino acid except Pro or Gly
  SITE (606)..(606): Xaa can be any amino acid
  SITE (607)..(607): Xaa can be any amino acid
  SITE (608)..(608): Xaa can be any amino acid
  SITE (610)..(610): Xaa can be any amino acid except Pro or Gly
  SITE (612)..(612): Xaa can be any amino acid
  SITE (613)..(613): Xaa can be any amino acid
  SITE (614)..(614): Xaa can be any amino acid
  SITE (616)..(616): Xaa can be any amino acid except Pro or Gly
  SITE (618)..(618): Xaa can be any amino acid
  SITE (619)..(619): Xaa can be any amino acid
  SITE (620)..(620): Xaa can be any amino acid
  SITE (622)..(622): Xaa can be any amino acid except Pro or Gly
  SITE (624)..(624): Xaa can be any amino acid
  SITE (625)..(625): Xaa can be any amino acid
  SITE (626)..(626): Xaa can be any amino acid
  SITE (628)..(628): Xaa can be any amino acid except Pro or Gly
  SITE (630)..(630): Xaa can be any amino acid
  SITE (631)..(631): Xaa can be any amino acid
  SITE (632)..(632): Xaa can be any amino acid
  SITE (634)..(634): Xaa can be any amino acid except Pro or Gly
  SITE (636)..(636): Xaa can be any amino acid
  SITE (637)..(637): Xaa can be any amino acid
  SITE (638)..(638): Xaa can be any amino acid
  SITE (640)..(640): Xaa can be any amino acid except Pro or Gly
  SITE (642)..(642): Xaa can be any amino acid
  SITE (643)..(643): Xaa can be any amino acid
  SITE (644)..(644): Xaa can be any amino acid
  SITE (646)..(646): Xaa can be any amino acid except Pro or Gly
  SITE (648)..(648): Xaa can be any amino acid
  SITE (649)..(649): Xaa can be any amino acid
  SITE (650)..(650): Xaa can be any amino acid
  SITE (652)..(652): Xaa can be any amino acid except Pro or Gly
  SITE (654)..(654): Xaa can be any amino acid
  SITE (655)..(655): Xaa can be any amino acid
  SITE (656)..(656): Xaa can be any amino acid
  SITE (658)..(658): Xaa can be any amino acid except Pro or Gly
  SITE (660)..(660): Xaa can be any amino acid
  SITE (661)..(661): Xaa can be any amino acid
  SITE (662)..(662): Xaa can be any amino acid
  SITE (664)..(664): Xaa can be any amino acid except Pro or Gly
  SITE (666)..(666): Xaa can be any amino acid
  SITE (667)..(667): Xaa can be any amino acid
  SITE (668)..(668): Xaa can be any amino acid
  SITE (670)..(670): Xaa can be any amino acid except Pro or Gly
  SITE (672)..(672): Xaa can be any amino acid
  SITE (673)..(673): Xaa can be any amino acid
  SITE (674)..(674): Xaa can be any amino acid
  SITE (676)..(676): Xaa can be any amino acid except Pro or Gly
  SITE (678)..(678): Xaa can be any amino acid
  SITE (679)..(679): Xaa can be any amino acid
  SITE (680)..(680): Xaa can be any amino acid
  SITE (682)..(682): Xaa can be any amino acid except Pro or Gly
  SITE (684)..(684): Xaa can be any amino acid
  SITE (685)..(685): Xaa can be any amino acid
  SITE (686)..(686): Xaa can be any amino acid
  SITE (688)..(688): Xaa can be any amino acid except Pro or Gly
  SITE (690)..(690): Xaa can be any amino acid
  SITE (691)..(691): Xaa can be any amino acid
  SITE (692)..(692): Xaa can be any amino acid
  SITE (694)..(694): Xaa can be any amino acid except Pro or Gly
  SITE (696)..(696): Xaa can be any amino acid
  SITE (697)..(697): Xaa can be any amino acid
  SITE (698)..(698): Xaa can be any amino acid
  SITE (700)..(700): Xaa can be any amino acid except Pro or Gly
  SITE (702)..(702): Xaa can be any amino acid
  SITE (703)..(703): Xaa can be any amino acid
  SITE (704)..(704): Xaa can be any amino acid
  SITE (706)..(706): Xaa can be any amino acid except Pro or Gly
  SITE (708)..(708): Xaa can be any amino acid
  SITE (709)..(709): Xaa can be any amino acid
  SITE (710)..(710): Xaa can be any amino acid
  SITE (712)..(712): Xaa can be any amino acid except Pro or Gly
  SITE (714)..(714): Xaa can be any amino acid
  SITE (715)..(715): Xaa can be any amino acid
  SITE (716)..(716): Xaa can be any amino acid
  SITE (718)..(718): Xaa can be any amino acid except Pro or Gly
  SITE (720)..(720): Xaa can be any amino acid
  SITE (721)..(721): Xaa can be any amino acid
  SITE (722)..(722): Xaa can be any amino acid
  SITE (724)..(724): Xaa can be any amino acid except Pro or Gly
  SITE (726)..(726): Xaa can be any amino acid
  SITE (727)..(727): Xaa can be any amino acid
  SITE (728)..(728): Xaa can be any amino acid
  SITE (730)..(730): Xaa can be any amino acid except Pro or Gly
  SITE (732)..(732): Xaa can be any amino acid
  SITE (733)..(733): Xaa can be any amino acid
  SITE (734)..(734): Xaa can be any amino acid
  SITE (736)..(736): Xaa can be any amino acid except Pro or Gly
  SITE (738)..(738): Xaa can be any amino acid
  SITE (739)..(739): Xaa can be any amino acid
  SITE (740)..(740): Xaa can be any amino acid
  SITE (742)..(742): Xaa can be any amino acid except Pro or Gly
  SITE (744)..(744): Xaa can be any amino acid
  SITE (745)..(745): Xaa can be any amino acid
  SITE (746)..(746): Xaa can be any amino acid
  SITE (748)..(748): Xaa can be any amino acid except Pro or Gly
  SITE (750)..(750): Xaa can be any amino acid
  SITE (751)..(751): Xaa can be any amino acid
  SITE (752)..(752): Xaa can be any amino acid
  SITE (754)..(754): Xaa can be any amino acid except Pro or Gly
  SITE (756)..(756): Xaa can be any amino acid
  SITE (757)..(757): Xaa can be any amino acid
  SITE (758)..(758): Xaa can be any amino acid
  SITE (760)..(760): Xaa can be any amino acid except Pro or Gly
  SITE (762)..(762): Xaa can be any amino acid
  SITE (763)..(763): Xaa can be any amino acid
  SITE (764)..(764): Xaa can be any amino acid
  SITE (766)..(766): Xaa can be any amino acid except Pro or Gly
  SITE (768)..(768): Xaa can be any amino acid
  SITE (769)..(769): Xaa can be any amino acid
  SITE (770)..(770): Xaa can be any amino acid
  SITE (772)..(772): Xaa can be any amino acid except Pro or Gly
  SITE (774)..(774): Xaa can be any amino acid
  SITE (775)..(775): Xaa can be any amino acid
  SITE (776)..(776): Xaa can be any amino acid
  SITE (778)..(778): Xaa can be any amino acid except Pro or Gly
  SITE (780)..(780): Xaa can be any amino acid
  SITE (781)..(781): Xaa can be any amino acid
  SITE (782)..(782): Xaa can be any amino acid
  SITE (784)..(784): Xaa can be any amino acid except Pro or Gly
  SITE (786)..(786): Xaa can be any amino acid
  SITE (787)..(787): Xaa can be any amino acid
  SITE (788)..(788): Xaa can be any amino acid
  SITE (790)..(790): Xaa can be any amino acid except Pro or Gly
  SITE (792)..(792): Xaa can be any amino acid
  SITE (793)..(793): Xaa can be any amino acid
  SITE (794)..(794): Xaa can be any amino acid
  SITE (796)..(796): Xaa can be any amino acid except Pro or Gly
  SITE (798)..(798): Xaa can be any amino acid
  SITE (799)..(799): Xaa can be any amino acid
  SITE (800)..(800): Xaa can be any amino acid
  SITE (802)..(802): Xaa can be any amino acid except Pro or Gly
  SITE (804)..(804): Xaa can be any amino acid
  SITE (805)..(805): Xaa can be any amino acid
  SITE (806)..(806): Xaa can be any amino acid
  SITE (808)..(808): Xaa can be any amino acid except Pro or Gly
  SITE (810)..(810): Xaa can be any amino acid
  SITE (811)..(811): Xaa can be any amino acid
  SITE (812)..(812): Xaa can be any amino acid
  SITE (814)..(814): Xaa can be any amino acid except Pro or Gly
  SITE (816)..(816): Xaa can be any amino acid
  SITE (817)..(817): Xaa can be any amino acid
  SITE (818)..(818): Xaa can be any amino acid
  SITE (820)..(820): Xaa can be any amino acid except Pro or Gly
  SITE (822)..(822): Xaa can be any amino acid
  SITE (823)..(823): Xaa can be any amino acid
  SITE (824)..(824): Xaa can be any amino acid
  SITE (826)..(826): Xaa can be any amino acid except Pro or Gly
  SITE (828)..(828): Xaa can be any amino acid
  SITE (829)..(829): Xaa can be any amino acid
  SITE (830)..(830): Xaa can be any amino acid
  SITE (832)..(832): Xaa can be any amino acid except Pro or Gly
  SITE (834)..(834): Xaa can be any amino acid
  SITE (835)..(835): Xaa can be any amino acid
  SITE (836)..(836): Xaa can be any amino acid
  SITE (838)..(838): Xaa can be any amino acid except Pro or Gly
  SITE (840)..(840): Xaa can be any amino acid
  SITE (841)..(841): Xaa can be any amino acid
  SITE (842)..(842): Xaa can be any amino acid
  SITE (844)..(844): Xaa can be any amino acid except Pro or Gly
  SITE (846)..(846): Xaa can be any amino acid
  SITE (847)..(847): Xaa can be any amino acid
  SITE (848)..(848): Xaa can be any amino acid
  SITE (850)..(850): Xaa can be any amino acid except Pro or Gly
  SITE (852)..(852): Xaa can be any amino acid
  SITE (853)..(853): Xaa can be any amino acid
  SITE (854)..(854): Xaa can be any amino acid
  SITE (856)..(856): Xaa can be any amino acid except Pro or Gly
  SITE (858)..(858): Xaa can be any amino acid
  SITE (859)..(859): Xaa can be any amino acid
  SITE (860)..(860): Xaa can be any amino acid
  SITE (862)..(862): Xaa can be any amino acid except Pro or Gly
  SITE (864)..(864): Xaa can be any amino acid
  SITE (865)..(865): Xaa can be any amino acid
  SITE (866)..(866): Xaa can be any amino acid
  SITE (868)..(868): Xaa can be any amino acid except Pro or Gly
  SITE (870)..(870): Xaa can be any amino acid
  SITE (871)..(871): Xaa can be any amino acid
  SITE (872)..(872): Xaa can be any amino acid
  SITE (874)..(874): Xaa can be any amino acid except Pro or Gly
  SITE (876)..(876): Xaa can be any amino acid
  SITE (877)..(877): Xaa can be any amino acid
  SITE (878)..(878): Xaa can be any amino acid
  SITE (880)..(880): Xaa can be any amino acid except Pro or Gly
  SITE (882)..(882): Xaa can be any amino acid
  SITE (883)..(883): Xaa can be any amino acid
  SITE (884)..(884): Xaa can be any amino acid
  SITE (886)..(886): Xaa can be any amino acid except Pro or Gly
  SITE (888)..(888): Xaa can be any amino acid
  SITE (889)..(889): Xaa can be any amino acid
  SITE (890)..(890): Xaa can be any amino acid
  SITE (892)..(892): Xaa can be any amino acid except Pro or Gly
  SITE (894)..(894): Xaa can be any amino acid
  SITE (895)..(895): Xaa can be any amino acid
  SITE (896)..(896): Xaa can be any amino acid
  SITE (898)..(898): Xaa can be any amino acid except Pro or Gly
  SITE (900)..(900): Xaa can be any amino acid
  SITE (901)..(901): Xaa can be any amino acid
  SITE (902)..(902): Xaa can be any amino acid
  SITE (904)..(904): Xaa can be any amino acid except Pro or Gly
  SITE (906)..(906): Xaa can be any amino acid
  SITE (907)..(907): Xaa can be any amino acid
  SITE (908)..(908): Xaa can be any amino acid
  SITE (910)..(910): Xaa can be any amino acid except Pro or Gly
  SITE (912)..(912): Xaa can be any amino acid
  SITE (913)..(913): Xaa can be any amino acid
  SITE (914)..(914): Xaa can be any amino acid
  SITE (916)..(916): Xaa can be any amino acid except Pro or Gly
  SITE (918)..(918): Xaa can be any amino acid
  SITE (919)..(919): Xaa can be any amino acid
  SITE (920)..(920): Xaa can be any amino acid
  SITE (922)..(922): Xaa can be any amino acid except Pro or Gly
  SITE (924)..(924): Xaa can be any amino acid
  SITE (925)..(925): Xaa can be any amino acid
  SITE (926)..(926): Xaa can be any amino acid
  SITE (928)..(928): Xaa can be any amino acid except Pro or Gly
  SITE (930)..(930): Xaa can be any amino acid
  SITE (931)..(931): Xaa can be any amino acid
  SITE (932)..(932): Xaa can be any amino acid
  SITE (934)..(934): Xaa can be any amino acid except Pro or Gly
  SITE (936)..(936): Xaa can be any amino acid
  SITE (937)..(937): Xaa can be any amino acid
  SITE (938)..(938): Xaa can be any amino acid
  SITE (940)..(940): Xaa can be any amino acid except Pro or Gly
  SITE (942)..(942): Xaa can be any amino acid
  SITE (943)..(943): Xaa can be any amino acid
  SITE (944)..(944): Xaa can be any amino acid
  SITE (946)..(946): Xaa can be any amino acid except Pro or Gly
  SITE (948)..(948): Xaa can be any amino acid
  SITE (949)..(949): Xaa can be any amino acid
  SITE (950)..(950): Xaa can be any amino acid
  SITE (952)..(952): Xaa can be any amino acid except Pro or Gly
  SITE (954)..(954): Xaa can be any amino acid
  SITE (955)..(955): Xaa can be any amino acid
  SITE (956)..(956): Xaa can be any amino acid
  SITE (958)..(958): Xaa can be any amino acid except Pro or Gly
  SITE (960)..(960): Xaa can be any amino acid
XXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGXXXPXGX

SEQ ID NO: 59 - protein, 1120 aa, Artificial Sequence
  elastin-like polypeptide
  SITE (1)..(1): Xaa can be any amino acid
  SITE (2)..(2): Xaa can be any amino acid
  SITE (4)..(4): Xaa can be any amino acid except Pro or Gly
  SITE (5)..(5): Xaa can be any amino acid except Pro or Gly
  SITE (7)..(7): Xaa can be any amino acid
  SITE (8)..(8): Xaa can be any amino acid
  SITE (9)..(9): Xaa can be any amino acid
  SITE (11)..(11): Xaa can be any amino acid except Pro or Gly
  SITE (12)..(12): Xaa can be any amino acid except Pro or Gly
  SITE (14)..(14): Xaa can be any amino acid
  SITE (15)..(15): Xaa can be any amino acid
  SITE (16)..(16): Xaa can be any amino acid
  SITE (18)..(18): Xaa can be any amino acid except Pro or Gly
  SITE (19)..(19): Xaa can be any amino acid except Pro or Gly
  SITE (21)..(21): Xaa can be any amino acid
  SITE (22)..(22): Xaa can be any amino acid
  SITE (23)..(23): Xaa can be any amino acid
  SITE (25)..(25): Xaa can be any amino acid except Pro or Gly
  SITE (26)..(26): Xaa can be any amino acid except Pro or Gly
  SITE (28)..(28): Xaa can be any amino acid
  SITE (29)..(29): Xaa can be any amino acid
  SITE (30)..(30): Xaa can be any amino acid
  SITE (32)..(32): Xaa can be any amino acid except Pro or Gly
  SITE (33)..(33): Xaa can be any amino acid except Pro or Gly
  SITE (35)..(35): Xaa can be any amino acid
  SITE (36)..(36): Xaa can be any amino acid
  SITE (37)..(37): Xaa can be any amino acid
  SITE (39)..(39): Xaa can be any amino acid except Pro or Gly
  SITE (40)..(40): Xaa can be any amino acid except Pro or Gly
  SITE (42)..(42): Xaa can be any amino acid
  SITE (43)..(43): Xaa can be any amino acid
  SITE (44)..(44): Xaa can be any amino acid
  SITE (46)..(46): Xaa can be any amino acid except Pro or Gly
  SITE (47)..(47): Xaa can be any amino acid except Pro or Gly
  SITE (49)..(49): Xaa can be any amino acid
  SITE (50)..(50): Xaa can be any amino acid
  SITE (51)..(51): Xaa can be any amino acid
  SITE (53)..(53): Xaa can be any amino acid except Pro or Gly
  SITE (54)..(54): Xaa can be any amino acid except Pro or Gly
  SITE (56)..(56): Xaa can be any amino acid
  SITE (57)..(57): Xaa can be any amino acid
  SITE (58)..(58): Xaa can be any amino acid
  SITE (60)..(60): Xaa can be any amino acid except Pro or Gly
  SITE (61)..(61): Xaa can be any amino acid except Pro or Gly
  SITE (63)..(63): Xaa can be any amino acid
  SITE (64)..(64): Xaa can be any amino acid
  SITE (65)..(65): Xaa can be any amino acid
  SITE (67)..(67): Xaa can be any amino acid except Pro or Gly
  SITE (68)..(68): Xaa can be any amino acid except Pro or Gly
  SITE (70)..(70): Xaa can be any amino acid
  SITE (71)..(1120): May be present or absent in groups of the repeat unit Xaa Xaa Pro Xaa Xaa Gly Xaa
  SITE (71)..(71): Xaa can be any amino acid
  SITE (72)..(72): Xaa can be any amino acid
  SITE (74)..(74): Xaa can be any amino acid except Pro or Gly
  SITE (75)..(75): Xaa can be any amino acid except Pro or Gly
  SITE (77)..(77): Xaa can be any amino acid
  SITE (78)..(78): Xaa can be any amino acid
  SITE (79)..(79): Xaa can be any amino acid
  SITE (81)..(81): Xaa can be any amino acid except Pro or Gly
  SITE (82)..(82): Xaa can be any amino acid except Pro or Gly
  SITE (84)..(84): Xaa can be any amino acid
  SITE (85)..(85): Xaa can be any amino acid
  SITE (86)..(86): Xaa can be any amino acid
  SITE (88)..(88): Xaa can be any amino acid except Pro or Gly
  SITE (89)..(89): Xaa can be any amino acid except Pro or Gly
  SITE (91)..(91): Xaa can be any amino acid
  SITE (92)..(92): Xaa can be any amino acid
  SITE (93)..(93): Xaa can be any amino acid
  SITE (95)..(95): Xaa can be any amino acid except Pro or Gly
  SITE (96)..(96): Xaa can be any amino acid except Pro or Gly
  SITE (98)..(98): Xaa can be any amino acid
  SITE (99)..(99): Xaa can be any amino acid
  SITE (100)..(100): Xaa can be any amino acid
  SITE (102)..(102): Xaa can be any amino acid except Pro or Gly
  SITE (103)..(103): Xaa can be any amino acid except Pro or Gly
  SITE (105)..(105): Xaa can be any amino acid
  SITE (106)..(106): Xaa can be any amino acid
  SITE (107)..(107): Xaa can be any amino acid
  SITE (109)..(109): Xaa can be any amino acid except Pro or Gly
  SITE (110)..(110): Xaa can be any amino acid except Pro or Gly
  SITE (112)..(112): Xaa can be any amino acid
  SITE (113)..(113): Xaa can be any amino acid
  SITE (114)..(114): Xaa can be any amino acid
  SITE (116)..(116): Xaa can be any amino acid except Pro or Gly
  SITE (117)..(117): Xaa can be any amino acid except Pro or Gly
  SITE (119)..(119): Xaa can be any amino acid
  SITE (120)..(120): Xaa can be any amino acid
  SITE (121)..(121): Xaa can be any amino acid
  SITE (123)..(123): Xaa can be any amino acid except Pro or Gly
  SITE (124)..(124): Xaa can be any amino acid except Pro or Gly
  SITE (126)..(126): Xaa can be any amino acid
  SITE (127)..(127): Xaa can be any amino acid
  SITE (128)..(128): Xaa can be any amino acid
  SITE (130)..(130): Xaa can be any amino acid except Pro or Gly
  SITE (131)..(131): Xaa can be any amino acid except Pro or Gly
  SITE (133)..(133): Xaa can be any amino acid
  SITE (134)..(134): Xaa can be any amino acid
  SITE (135)..(135): Xaa can be any amino acid
  SITE (137)..(137): Xaa can be any amino acid except Pro or Gly
  SITE (138)..(138): Xaa can be any amino acid except Pro or Gly
  SITE (140)..(140): Xaa can be any amino acid
  SITE (141)..(141): Xaa can be any amino acid
  SITE (142)..(142): Xaa can be any amino acid
  SITE (144)..(144): Xaa can be any amino acid except Pro or Gly
  SITE (145)..(145): Xaa can be any amino acid except Pro or Gly
  SITE (147)..(147): Xaa can be any amino acid
  SITE (148)..(148): Xaa can be any amino acid
  SITE (149)..(149): Xaa can be any amino acid
  SITE (151)..(151): Xaa can be any amino acid except Pro or Gly
  SITE (152)..(152): Xaa can be any amino acid except Pro or Gly
  SITE (154)..(154): Xaa can be any amino acid
  SITE (155)..(155): Xaa can be any amino acid
  SITE (156)..(156): Xaa can be any amino acid
  SITE (158)..(158): Xaa can be any amino acid except Pro or Gly
  SITE (159)..(159): Xaa can be any amino acid except Pro or Gly
  SITE (161)..(161): Xaa can be any amino acid
  SITE (162)..(162): Xaa can be any amino acid
  SITE (163)..(163): Xaa can be any amino acid
  SITE (165)..(165): Xaa can be any amino acid except Pro or Gly
  SITE (166)..(166): Xaa can be any amino acid except Pro or Gly
  SITE (168)..(168): Xaa can be any amino acid
  SITE (169)..(169): Xaa can be any amino acid
  SITE (170)..(170): Xaa can be any amino acid
  SITE (172)..(172): Xaa can be any amino acid except Pro or Gly
  SITE (173)..(173): Xaa can be any amino acid except Pro or Gly
  SITE (175)..(175): Xaa can be any amino acid
  SITE (176)..(176): Xaa can be any amino acid
  SITE (177)..(177): Xaa can be any amino acid
  SITE (179)..(179): Xaa can be any amino acid except Pro or Gly
  SITE (180)..(180): Xaa can be any amino acid except Pro or Gly
  SITE (182)..(182): Xaa can be any amino acid
  SITE (183)..(183): Xaa can be any amino acid
  SITE (184)..(184): Xaa can be any amino acid
  SITE (186)..(186): Xaa can be any amino acid except Pro or Gly
  SITE (187)..(187): Xaa can be any amino acid except Pro or Gly
  SITE (189)..(189): Xaa can be any amino acid
  SITE (190)..(190): Xaa can be any amino acid
  SITE (191)..(191): Xaa can be any amino acid
  SITE (193)..(193): Xaa can be any amino acid except Pro or Gly
  SITE (194)..(194): Xaa can be any amino acid except Pro or Gly
  SITE (196)..(196): Xaa can be any amino acid
  SITE (197)..(197): Xaa can be any amino acid
  SITE (198)..(198): Xaa can be any amino acid
  SITE (200)..(200): Xaa can be any amino acid except Pro or Gly
  SITE (201)..(201): Xaa can be any amino acid except Pro or Gly
  SITE (203)..(203): Xaa can be any amino acid
  SITE (204)..(204): Xaa can be any amino acid
  SITE (205)..(205): Xaa can be any amino acid
  SITE (207)..(207): Xaa can be any amino acid except Pro or Gly
  SITE (208)..(208): Xaa can be any amino acid except Pro or Gly
  SITE (210)..(210): Xaa can be any amino acid
  SITE (211)..(211): Xaa can be any amino acid
  SITE (212)..(212): Xaa can be any amino acid
  SITE (214)..(214): Xaa can be any amino acid except Pro or Gly
  SITE (215)..(215): Xaa can be any amino acid except Pro or Gly
  SITE (217)..(217): Xaa can be any amino acid
  SITE (218)..(218): Xaa can be any amino acid
  SITE (219)..(219): Xaa can be any amino acid
  SITE (221)..(221): Xaa can be any amino acid except Pro or Gly
  SITE (222)..(222): Xaa can be any amino acid except Pro or Gly
  SITE (224)..(224): Xaa can be any amino acid
  SITE (225)..(225): Xaa can be any amino acid
  SITE (226)..(226): Xaa can be any amino acid
  SITE (228)..(228): Xaa can be any amino acid except Pro or Gly
  SITE (229)..(229): Xaa can be any amino acid except Pro or Gly
  SITE (231)..(231): Xaa can be any amino acid
  SITE (232)..(232): Xaa can be any amino acid
  SITE (233)..(233): Xaa can be any amino acid
  SITE (235)..(235): Xaa can be any amino acid except Pro or Gly
  SITE (236)..(236): Xaa can be any amino acid except Pro or Gly
  SITE (238)..(238): Xaa can be any amino acid
  SITE (239)..(239): Xaa can be any amino acid
  SITE (240)..(240): Xaa can be any amino acid
  SITE (242)..(242): Xaa can be any amino acid except Pro or Gly
  SITE (243)..(243): Xaa can be any amino acid except Pro or Gly
  SITE (245)..(245): Xaa can be any amino acid
  SITE (246)..(246): Xaa can be any amino acid
  SITE (247)..(247): Xaa can be any amino acid
  SITE (249)..(249): Xaa can be any amino acid except Pro or Gly
  SITE (250)..(250): Xaa can be any amino acid except Pro or Gly
  SITE (252)..(252): Xaa can be any amino acid
  SITE (253)..(253): Xaa can be any amino acid
  SITE (254)..(254): Xaa can be any amino acid
  SITE (256)..(256): Xaa can be any amino acid except Pro or Gly
  SITE (257)..(257): Xaa can be any amino acid except Pro or Gly
  SITE (259)..(259): Xaa can be any amino acid
  SITE (260)..(260): Xaa can be any amino acid
  SITE (261)..(261): Xaa can be any amino acid
  SITE (263)..(263): Xaa can be any amino acid except Pro or Gly
  SITE (264)..(264): Xaa can be any amino acid except Pro or Gly
  SITE (266)..(266): Xaa can be any amino acid
  SITE (267)..(267): Xaa can be any amino acid
  SITE (268)..(268): Xaa can be any amino acid
  SITE (270)..(270): Xaa can be any amino acid except Pro or Gly
  SITE (271)..(271): Xaa can be any amino acid except Pro or Gly
  SITE (273)..(273): Xaa can be any amino acid
  SITE (274)..(274): Xaa can be any amino acid
  SITE (275)..(275): Xaa can be any amino acid
  SITE (277)..(277): Xaa can be any amino acid except Pro or Gly
  SITE (278)..(278): Xaa can be any amino acid except Pro or Gly
  SITE (280)..(280): Xaa can be any amino acid
  SITE (281)..(281): Xaa can be any amino acid
  SITE (282)..(282): Xaa can be any amino acid
  SITE (284)..(284): Xaa can be any amino acid except Pro or Gly
  SITE (285)..(285): Xaa can be any amino acid except Pro or Gly
  SITE (287)..(287): Xaa can be any amino acid
  SITE (288)..(288): Xaa can be any amino acid
  SITE (289)..(289): Xaa can be any amino acid
  SITE (291)..(291): Xaa can be any amino acid except Pro or Gly
  SITE (292)..(292): Xaa can be any amino acid except Pro or Gly
  SITE (294)..(294): Xaa can be any amino acid
  SITE (295)..(295): Xaa can be any amino acid
  SITE (296)..(296): Xaa can be any amino acid
  SITE (298)..(298): Xaa can be any amino acid except Pro or Gly
  SITE (299)..(299): Xaa can be any amino acid except Pro or Gly
  SITE (301)..(301): Xaa can be any amino acid
  SITE (302)..(302): Xaa can be any amino acid
  SITE (303)..(303): Xaa can be any amino acid
  SITE (305)..(305): Xaa can be any amino acid except Pro or Gly
  SITE (306)..(306): Xaa can be any amino acid except Pro or Gly
  SITE (308)..(308): Xaa can be any amino acid
  SITE (309)..(309): Xaa can be any amino acid
  SITE (310)..(310): Xaa can be any amino acid
  SITE (312)..(312): Xaa can be any amino acid except Pro or Gly
  SITE (313)..(313): Xaa can be any amino acid except Pro or Gly
  SITE (315)..(315): Xaa can be any amino acid
  SITE (316)..(316): Xaa can be any amino acid
  SITE (317)..(317): Xaa can be any amino acid
  SITE (319)..(319): Xaa can be any amino acid except Pro or Gly
  SITE (320)..(320): Xaa can be any amino acid except Pro or Gly
  SITE (322)..(322): Xaa can be any amino acid
  SITE (323)..(323): Xaa can be any amino acid
  SITE (324)..(324): Xaa can be any amino acid
  SITE (326)..(326): Xaa can be any amino acid except Pro or Gly
  SITE (327)..(327): Xaa can be any amino acid except Pro or Gly
  SITE (329)..(329): Xaa can be any amino acid
  SITE (330)..(330): Xaa can be any amino acid
  SITE (331)..(331): Xaa can be any amino acid
  SITE (333)..(333): Xaa can be any amino acid except Pro or Gly
  SITE (334)..(334): Xaa can be any amino acid except Pro or Gly
  SITE (336)..(336): Xaa can be any amino acid
  SITE (337)..(337): Xaa can be any amino acid
  SITE (338)..(338): Xaa can be any amino acid
  SITE (340)..(340): Xaa can be any amino acid except Pro or Gly
  SITE (341)..(341): Xaa can be any amino acid except Pro or Gly
  SITE (343)..(343): Xaa can be any amino acid
  SITE (344)..(344): Xaa can be any amino acid
  SITE (345)..(345): Xaa can be any amino acid
  SITE (347)..(347): Xaa can be any amino acid except Pro or Gly
  SITE (348)..(348): Xaa can be any amino acid except Pro or Gly
  SITE (350)..(350): Xaa can be any amino acid
  SITE (351)..(351): Xaa can be any amino acid
  SITE (352)..(352): Xaa can be any amino acid
  SITE (354)..(354): Xaa can be any amino acid except Pro or Gly
  SITE (355)..(355): Xaa can be any amino acid except Pro or Gly
  SITE (357)..(357): Xaa can be any amino acid
  SITE (358)..(358): Xaa can be any amino acid
  SITE (359)..(359): Xaa can be any amino acid
  SITE (361)..(361): Xaa can be any amino acid except Pro or Gly
  SITE (362)..(362): Xaa can be any amino acid except Pro or Gly
  SITE (364)..(364): Xaa can be any amino acid
  SITE (365)..(365): Xaa can be any amino acid
  SITE (366)..(366): Xaa can be any amino acid
  SITE (368)..(368): Xaa can be any amino acid except Pro or Gly
  SITE (369)..(369): Xaa can be any amino acid except Pro or Gly
  SITE (371)..(371): Xaa can be any amino acid
  SITE (372)..(372): Xaa can be any amino acid
  SITE (373)..(373): Xaa can be any amino acid
  SITE (375)..(375): Xaa can be any amino acid except Pro or Gly
  SITE (376)..(376): Xaa can be any amino acid except Pro or Gly
  SITE (378)..(378): Xaa can be any amino acid
  SITE (379)..(379): Xaa can be any amino acid
  SITE (380)..(380): Xaa can be any amino acid
  SITE (382)..(382): Xaa can be any amino acid except Pro or Gly
  SITE (383)..(383): Xaa can be any amino acid except Pro or Gly
  SITE (385)..(385): Xaa can be any amino acid
  SITE (386)..(386): Xaa can be any amino acid
  SITE (387)..(387): Xaa can be any amino acid
  SITE (389)..(389): Xaa can be any amino acid except Pro or Gly
  SITE (390)..(390): Xaa can be any amino acid except Pro or Gly
  SITE (392)..(392): Xaa can be any amino acid
  SITE (393)..(393): Xaa can be any amino acid
  SITE (394)..(394): Xaa can be any amino acid
  SITE (396)..(396): Xaa can be any amino acid except Pro or Gly
  SITE (397)..(397): Xaa can be any amino acid except Pro or Gly
  SITE (399)..(399): Xaa can be any amino acid
  SITE (400)..(400): Xaa can be any amino acid
  SITE (401)..(401): Xaa can be any amino acid
  SITE (403)..(403): Xaa can be any amino acid except Pro or Gly
  SITE (404)..(404): Xaa can be any amino acid except Pro or Gly
  SITE (406)..(406): Xaa can be any amino acid
  SITE (407)..(407): Xaa can be any amino acid
  SITE (408)..(408): Xaa can be any amino acid
  SITE (410)..(410): Xaa can be any amino acid except Pro or Gly
  SITE (411)..(411): Xaa can be any amino acid except Pro or Gly
  SITE (413)..(413): Xaa can be any amino acid
  SITE (414)..(414): Xaa can be any amino acid
  SITE (415)..(415): Xaa can be any amino acid
  SITE (417)..(417): Xaa can be any amino acid except Pro or Gly
  SITE (418)..(418): Xaa can be any amino acid except Pro or Gly
  SITE (420)..(420): Xaa can be any amino acid
  SITE (421)..(421): Xaa can be any amino acid
  SITE (422)..(422): Xaa can be any amino acid
  SITE (424)..(424): Xaa can be any amino acid except Pro or Gly
  SITE (425)..(425): Xaa can be any amino acid except Pro or Gly
  SITE (427)..(427): Xaa can be any amino acid
  SITE (428)..(428): Xaa can be any amino acid
  SITE (429)..(429): Xaa can be any amino acid
  SITE (431)..(431): Xaa can be any amino acid except Pro or Gly
  SITE (432)..(432): Xaa can be any amino acid except Pro or Gly
  SITE (434)..(434): Xaa can be any amino acid
  SITE (435)..(435): Xaa can be any amino acid
  SITE (436)..(436): Xaa can be any amino acid
  SITE (438)..(438): Xaa can be any amino acid except Pro or Gly
  SITE (439)..(439): Xaa can be any amino acid except Pro or Gly
  SITE (441)..(441): Xaa can be any amino acid
  SITE (442)..(442): Xaa can be any amino acid
  SITE (443)..(443): Xaa can be any amino acid
  SITE (445)..(445): Xaa can be any amino acid except Pro or Gly
  SITE (446)..(446): Xaa can be any amino acid except Pro or Gly
  SITE (448)..(448): Xaa can be any amino acid
  SITE (449)..(449): Xaa can be any amino acid
  SITE (450)..(450): Xaa can be any amino acid
  SITE (452)..(452): Xaa can be any amino acid except Pro or Gly
  SITE (453)..(453): Xaa can be any amino acid except Pro or Gly
  SITE (455)..(455): Xaa can be any amino acid
  SITE (456)..(456): Xaa can be any amino acid
  SITE (457)..(457): Xaa can be any amino acid
  SITE (459)..(459): Xaa can be any amino acid except Pro or Gly
  SITE (460)..(460): Xaa can be any amino acid except Pro or Gly
  SITE (462)..(462): Xaa can be any amino acid
  SITE (463)..(463): Xaa can be any amino acid
  SITE (464)..(464): Xaa can be any amino acid
  SITE (466)..(466): Xaa can be any amino acid except Pro or Gly
  SITE (467)..(467): Xaa can be any amino acid except Pro or Gly
  SITE (469)..(469): Xaa can be any amino acid
  SITE (470)..(470): Xaa can be any amino acid
  SITE (471)..(471): Xaa can be any amino acid
  SITE (473)..(473): Xaa can be any amino acid except Pro or Gly
  SITE (474)..(474): Xaa can be any amino acid except Pro or Gly
  SITE (476)..(476): Xaa can be any amino acid
  SITE (477)..(477): Xaa can be any amino acid
  SITE (478)..(478): Xaa can be any amino acid
  SITE (480)..(480): Xaa can be any amino acid except Pro or Gly
  SITE (481)..(481): Xaa can be any amino acid except Pro or Gly
  SITE (483)..(483): Xaa can be any amino acid
  SITE (484)..(484): Xaa can be any amino acid
  SITE (485)..(485): Xaa can be any amino acid
  SITE (487)..(487): Xaa can be any amino acid except Pro or Gly
  SITE (488)..(488): Xaa can be any amino acid except Pro or Gly
  SITE (490)..(490): Xaa can be any amino acid
  SITE (491)..(491): Xaa can be any amino acid
  SITE (492)..(492): Xaa can be any amino acid
  SITE (494)..(494): Xaa can be any amino acid except Pro or Gly
  SITE (495)..(495): Xaa can be any amino acid except Pro or Gly
  SITE (497)..(497): Xaa can be any amino acid
  SITE (498)..(498): Xaa can be any amino acid
  SITE (499)..(499): Xaa can be any amino acid
  SITE (501)..(501): Xaa can be any amino acid except Pro or Gly
  SITE (502)..(502): Xaa can be any amino acid except Pro or Gly
  SITE (504)..(504): Xaa can be any amino acid
  SITE (505)..(505): Xaa can be any amino acid
  SITE (506)..(506): Xaa can be any amino acid
  SITE (508)..(508): Xaa can be any amino acid except Pro or Gly
  SITE (509)..(509): Xaa can be any amino acid except Pro or Gly
  SITE (511)..(511): Xaa can be any amino acid
  SITE (512)..(512): Xaa can be any amino acid
  SITE (513)..(513): Xaa can be any amino acid
  SITE (515)..(515): Xaa can be any amino acid except Pro or Gly
  SITE (516)..(516): Xaa can be any amino acid except Pro or Gly
  SITE (518)..(518): Xaa can be any amino acid
  SITE (519)..(519): Xaa can be any amino acid
  SITE (520)..(520): Xaa can be any amino acid
  SITE (522)..(522): Xaa can be any amino acid except Pro or Gly
  SITE (523)..(523): Xaa can be any amino acid except Pro or Gly
  SITE (525)..(525): Xaa can be any amino acid
  SITE (526)..(526): Xaa can be any amino acid
  SITE (527)..(527): Xaa can be any amino acid
  SITE (529)..(529): Xaa can be any amino acid except Pro or Gly
  SITE (530)..(530): Xaa can be any amino acid except Pro or Gly
  SITE (532)..(532): Xaa can be any amino acid
  SITE (533)..(533): Xaa can be any amino acid
  SITE (534)..(534): Xaa can be any amino acid
  SITE (536)..(536): Xaa can be any amino acid except Pro or Gly
  SITE (537)..(537): Xaa can be any amino acid except Pro or Gly
  SITE (539)..(539): Xaa can be any amino acid
  SITE (540)..(540): Xaa can be any amino acid
  SITE (541)..(541): Xaa can be any amino acid
  SITE (543)..(543): Xaa can be any amino acid except Pro or Gly
  SITE (544)..(544): Xaa can be any amino acid except Pro or Gly
  SITE (546)..(546): Xaa can be any amino acid
  SITE (547)..(547): Xaa can be any amino acid
  SITE (548)..(548): Xaa can be any amino acid
  SITE (550)..(550): Xaa can be any amino acid except Pro or Gly
  SITE (551)..(551): Xaa can be any amino acid except Pro or Gly
  SITE (553)..(553): Xaa can be any amino acid
  SITE (554)..(554): Xaa can be any amino acid
  SITE (555)..(555): Xaa can be any amino acid
  SITE (557)..(557): Xaa can be any amino acid except Pro or Gly
  SITE (558)..(558): Xaa can be any amino acid except Pro or Gly
  SITE (560)..(560): Xaa can be any amino acid
  SITE (561)..(561): Xaa can be any amino acid
  SITE (562)..(562): Xaa can be any amino acid
  SITE (564)..(564): Xaa can be any amino acid except Pro or Gly
  SITE (565)..(565): Xaa can be any amino acid except Pro or Gly
  SITE (567)..(567): Xaa can be any amino acid
  SITE (568)..(568): Xaa can be any amino acid
  SITE (569)..(569): Xaa can be any amino acid
  SITE (571)..(571): Xaa can be any amino acid except Pro or Gly
  SITE (572)..(572): Xaa can be any amino acid except Pro or Gly
  SITE (574)..(574): Xaa can be any amino acid
  SITE (575)..(575): Xaa can be any amino acid
  SITE (576)..(576): Xaa can be any amino acid
  SITE (578)..(578): Xaa can be any amino acid except Pro or Gly
  SITE (579)..(579): Xaa can be any amino acid except Pro or Gly
  SITE (581)..(581): Xaa can be any amino acid
  SITE (582)..(582): Xaa can be any amino acid
  SITE (583)..(583): Xaa can be any amino acid
  SITE (585)..(585): Xaa can be any amino acid except Pro or Gly
  SITE (586)..(586): Xaa can be any amino acid except Pro or Gly
  SITE (588)..(588): Xaa can be any amino acid
  SITE (589)..(589): Xaa can be any amino acid
  SITE (590)..(590): Xaa can be any amino acid
  SITE (592)..(592): Xaa can be any amino acid except Pro or Gly
  SITE (593)..(593): Xaa can be any amino acid except Pro or Gly
  SITE (595)..(595): Xaa can be any amino acid
  SITE (596)..(596): Xaa can be any amino acid
  SITE (597)..(597): Xaa can be any amino acid
  SITE (599)..(599): Xaa can be any amino acid except Pro or Gly
  SITE (600)..(600): Xaa can be any amino acid except Pro or Gly
  SITE (602)..(602): Xaa can be any amino acid
  SITE (603)..(603): Xaa can be any amino acid
  SITE (604)..(604): Xaa can be any amino acid
  SITE (606)..(606): Xaa can be any amino acid except Pro or Gly
  SITE (607)..(607): Xaa can be any amino acid except Pro or Gly
  SITE (609)..(609): Xaa can be any amino acid
  SITE (610)..(610): Xaa can be any amino acid
  SITE (611)..(611): Xaa can be any amino acid
  SITE (613)..(613): Xaa can be any amino acid except Pro or Gly
  SITE (614)..(614): Xaa can be any amino acid except Pro or Gly
  SITE (616)..(616): Xaa can be any amino acid
  SITE (617)..(617): Xaa can be any amino acid
  SITE (618)..(618): Xaa can be any amino acid
  SITE (620)..(620): Xaa can be any amino acid except Pro or Gly
  SITE (621)..(621): Xaa can be any amino acid except Pro or Gly
  SITE (623)..(623): Xaa can be any amino acid
  SITE (624)..(624): Xaa can be any amino acid
  SITE (625)..(625): Xaa can be any amino acid
  SITE (627)..(627): Xaa can be any amino acid except Pro or Gly
  SITE (628)..(628): Xaa can be any amino acid except Pro or Gly
  SITE (630)..(630): Xaa can be any amino acid
  SITE (631)..(631): Xaa can be any amino acid
  SITE (632)..(632): Xaa can be any amino acid
  SITE (634)..(634): Xaa can be any amino acid except Pro or Gly
  SITE (635)..(635): Xaa can be any amino acid except Pro or Gly
  SITE (637)..(637): Xaa can be any amino acid
  SITE (638)..(638): Xaa can be any amino acid
  SITE (639)..(639): Xaa can be any amino acid
  SITE (641)..(641): Xaa can be any amino acid except Pro or Gly
  SITE (642)..(642): Xaa can be any amino acid except Pro or Gly
  SITE (644)..(644): Xaa can be any amino acid
  SITE (645)..(645): Xaa can be any amino acid
  SITE (646)..(646): Xaa can be any amino acid
  SITE (648)..(648): Xaa can be any amino acid except Pro or Gly
  SITE (649)..(649): Xaa can be any amino acid except Pro or Gly
  SITE (651)..(651): Xaa can be any amino acid
  SITE (652)..(652): Xaa can be any amino acid
  SITE (653)..(653): Xaa can be any amino acid
  SITE (655)..(655): Xaa can be any amino acid except Pro or Gly
  SITE (656)..(656): Xaa can be any amino acid except Pro or Gly
  SITE (658)..(658): Xaa can be any amino acid
  SITE (659)..(659): Xaa can be any amino acid
  SITE (660)..(660): Xaa can be any amino acid
  SITE (662)..(662): Xaa can be any amino acid except Pro or Gly
  SITE (663)..(663): Xaa can be any amino acid except Pro or Gly
  SITE (665)..(665): Xaa can be any amino acid
  SITE (666)..(666): Xaa can be any amino acid
  SITE (667)..(667): Xaa can be any amino acid
  SITE (669)..(669): Xaa can be any amino acid except Pro or Gly
  SITE (670)..(670): Xaa can be any amino acid except Pro or Gly
  SITE (672)..(672): Xaa can be any amino acid
  SITE (673)..(673): Xaa can be any amino acid
  SITE (674)..(674): Xaa can be any amino acid
  SITE (676)..(676): Xaa can be any amino acid except Pro or Gly
  SITE (677)..(677): Xaa can be any amino acid except Pro or Gly
  SITE (679)..(679): Xaa can be any amino acid
  SITE (680)..(680): Xaa can be any amino acid
  SITE (681)..(681): Xaa can be any amino acid
  SITE (683)..(683): Xaa can be any amino acid except Pro or Gly
  SITE (684)..(684): Xaa can be any amino acid except Pro or Gly
  SITE (686)..(686): Xaa can be any amino acid
  SITE (687)..(687): Xaa can be any amino acid
  SITE (688)..(688): Xaa can be any amino acid
  SITE (690)..(690): Xaa can be any amino acid except Pro or Gly
  SITE (691)..(691): Xaa can be any amino acid except Pro or Gly
  SITE (693)..(693): Xaa can be any amino acid
  SITE (694)..(694): Xaa can be any amino acid
  SITE (695)..(695): Xaa can be any amino acid
  SITE (697)..(697): Xaa can be any amino acid except Pro or Gly
  SITE (698)..(698): Xaa can be any amino acid except Pro or Gly
  SITE (700)..(700): Xaa can be any amino acid
  SITE (701)..(701): Xaa can be any amino acid
  SITE (702)..(702): Xaa can be any amino acid
  SITE (704)..(704): Xaa can be any amino acid except Pro or Gly
  SITE (705)..(705): Xaa can be any amino acid except Pro or Gly
  SITE (707)..(707): Xaa can be any amino acid
  SITE (708)..(708): Xaa can be any amino acid
  SITE (709)..(709): Xaa can be any amino acid
  SITE (711)..(711): Xaa can be any amino acid except Pro or Gly
  SITE (712)..(712): Xaa can be any amino acid except Pro or Gly
  SITE (714)..(714): Xaa can be any amino acid
  SITE (715)..(715): Xaa can be any amino acid
  SITE (716)..(716): Xaa can be any amino acid
  SITE (718)..(718): Xaa can be any amino acid except Pro or Gly
  SITE (719)..(719): Xaa can be any amino acid except Pro or Gly
  SITE (721)..(721): Xaa can be any amino acid
  SITE (722)..(722): Xaa can be any amino acid
  SITE (723)..(723): Xaa can be any amino acid
  SITE (725)..(725): Xaa can be any amino acid except Pro or Gly
  SITE (726)..(726): Xaa can be any amino acid except Pro or Gly
  SITE (728)..(728): Xaa can be any amino acid
  SITE (729)..(729): Xaa can be any amino acid
  SITE (730)..(730): Xaa can be any amino acid
  SITE (732)..(732): Xaa can be any amino acid except Pro or Gly
  SITE (733)..(733): Xaa can be any amino acid except Pro or Gly
  SITE (735)..(735): Xaa can be any amino acid
  SITE (736)..(736): Xaa can be any amino acid
  SITE (737)..(737): Xaa can be any amino acid
  SITE (739)..(739): Xaa can be any amino acid except Pro or Gly
  SITE (740)..(740): Xaa can be any amino acid except Pro or Gly
  SITE (742)..(742): Xaa can be any amino acid
  SITE (743)..(743): Xaa can be any amino acid
  SITE (744)..(744): Xaa can be any amino acid
  SITE (746)..(746): Xaa can be any amino acid except Pro or Gly
  SITE (747)..(747): Xaa can be any amino acid except Pro or Gly
  SITE (749)..(749): Xaa can be any amino acid
  SITE (750)..(750): Xaa can be any amino acid
  SITE (751)..(751): Xaa can be any amino acid
  SITE (753)..(753): Xaa can be any amino acid except Pro or Gly
  SITE (754)..(754): Xaa can be any amino acid except Pro or Gly
  SITE (756)..(756): Xaa can be any amino acid
  SITE (757)..(757): Xaa can be any amino acid
  SITE (758)..(758): Xaa can be any amino acid
  SITE (760)..(760): Xaa can be any amino acid except Pro or Gly
  SITE (761)..(761): Xaa can be any amino acid except Pro or Gly
  SITE (763)..(763): Xaa can be any amino acid
  SITE (764)..(764): Xaa can be any amino acid
  SITE (765)..(765): Xaa can be any amino acid
  SITE (767)..(767): Xaa can be any amino acid except Pro or Gly
  SITE (768)..(768): Xaa can be any amino acid except Pro or Gly
  SITE (770)..(770): Xaa can be any amino acid
  SITE (771)..(771): Xaa can be any amino acid
  SITE (772)..(772): Xaa can be any amino acid
  SITE (774)..(774): Xaa can be any amino acid except Pro or Gly
  SITE (775)..(775): Xaa can be any amino acid except Pro or Gly
  SITE (777)..(777): Xaa can be any amino acid
  SITE (778)..(778): Xaa can be any amino acid
  SITE (779)..(779): Xaa can be any amino acid
  SITE (781)..(781): Xaa can be any amino acid except Pro or Gly
  SITE (782)..(782): Xaa can be any amino acid except Pro or Gly
  SITE (784)..(784): Xaa can be any amino acid
  SITE (785)..(785): Xaa can be any amino acid
  SITE (786)..(786): Xaa can be any amino acid
  SITE (788)..(788): Xaa can be any amino acid except Pro or Gly
  SITE (789)..(789): Xaa can be any amino acid except Pro or Gly
  SITE (791)..(791): Xaa can be any amino acid
  SITE (792)..(792): Xaa can be any amino acid
  SITE (793)..(793): Xaa can be any amino acid
  SITE (795)..(795): Xaa can be any amino acid except Pro or Gly
  SITE (796)..(796): Xaa can be any amino acid except Pro or Gly
  SITE (798)..(798): Xaa can be any amino acid
  SITE (799)..(799): Xaa can be any amino acid
  SITE (800)..(800): Xaa can be any amino acid
  SITE (802)..(802): Xaa can be any amino acid except Pro or Gly
  SITE (803)..(803): Xaa can be any amino acid except Pro or Gly
  SITE (805)..(805): Xaa can be any amino acid
  SITE (806)..(806): Xaa can be any amino acid
  SITE (807)..(807): Xaa can be any amino acid
  SITE (809)..(809): Xaa can be any amino acid except Pro or Gly
  SITE (810)..(810): Xaa can be any amino acid except Pro or Gly
  SITE (812)..(812): Xaa can be any amino acid
  SITE (813)..(813): Xaa can be any amino acid
  SITE (814)..(814): Xaa can be any amino acid
  SITE (816)..(816): Xaa can be any amino acid except Pro or Gly
  SITE (817)..(817): Xaa can be any amino acid except Pro or Gly
  SITE (819)..(819): Xaa can be any amino acid
  SITE (820)..(820): Xaa can be any amino acid
  SITE (821)..(821): Xaa can be any amino acid
  SITE (823)..(823): Xaa can be any amino acid except Pro or Gly
  SITE (824)..(824): Xaa can be any amino acid except Pro or Gly
  SITE (826)..(826): Xaa can be any amino acid
  SITE (827)..(827): Xaa can be any amino acid
  SITE (828)..(828): Xaa can be any amino acid
  SITE (830)..(830): Xaa can be any amino acid except Pro or Gly
  SITE (831)..(831): Xaa can be any amino acid except Pro or Gly
  SITE (833)..(833): Xaa can be any amino acid
  SITE (834)..(834): Xaa can be any amino acid
  SITE (835)..(835): Xaa can be any amino acid
  SITE (837)..(837): Xaa can be any amino acid except Pro or Gly
  SITE (838)..(838): Xaa can be any amino acid except Pro or Gly
  SITE (840)..(840): Xaa can be any amino acid
  SITE (841)..(841): Xaa can be any amino acid
  SITE (842)..(842): Xaa can be any amino acid
  SITE (844)..(844): Xaa can be any amino acid except Pro or Gly
  SITE (845)..(845): Xaa can be any amino acid except Pro or Gly
  SITE (847)..(847): Xaa can be any amino acid
  SITE (848)..(848): Xaa can be any amino acid
  SITE (849)..(849): Xaa can be any amino acid
  SITE (851)..(851): Xaa can be any amino acid except Pro or Gly
  SITE (852)..(852): Xaa can be any amino acid except Pro or Gly
  SITE (854)..(854): Xaa can be any amino acid
  SITE (855)..(855): Xaa can be any amino acid
  SITE (856)..(856): Xaa can be any amino acid
  SITE (858)..(858): Xaa can be any amino acid except Pro or Gly
  SITE (859)..(859): Xaa can be any amino acid except Pro or Gly
  SITE (861)..(861): Xaa can be any amino acid
  SITE (862)..(862): Xaa can be any amino acid
  SITE (863)..(863): Xaa can be any amino acid
  SITE (865)..(865): Xaa can be any amino acid except Pro or Gly
  SITE (866)..(866): Xaa can be any amino acid except Pro or Gly
  SITE (868)..(868): Xaa can be any amino acid
  SITE (869)..(869): Xaa can be any amino acid
  SITE (870)..(870): Xaa can be any amino acid
  SITE (872)..(872): Xaa can be any amino acid except Pro or Gly
  SITE (873)..(873): Xaa can be any amino acid except Pro or Gly
  SITE (875)..(875): Xaa can be any amino acid
  SITE (876)..(876): Xaa can be any amino acid
  SITE (877)..(877): Xaa can be any amino acid
  SITE (879)..(879): Xaa can be any amino acid except Pro or Gly
  SITE (880)..(880): Xaa can be any amino acid except Pro or Gly
  SITE (882)..(882): Xaa can be any amino acid
  SITE (883)..(883): Xaa can be any amino acid
  SITE (884)..(884): Xaa can be any amino acid
  SITE (886)..(886): Xaa can be any amino acid except Pro or Gly
  SITE (887)..(887): Xaa can be any amino acid except Pro or Gly
  SITE (889)..(889): Xaa can be any amino acid
  SITE (890)..(890): Xaa can be any amino acid
  SITE (891)..(891): Xaa can be any amino acid
  SITE (893)..(893): Xaa can be any amino acid except Pro or Gly
  SITE (894)..(894): Xaa can be any amino acid except Pro or Gly
  SITE (896)..(896): Xaa can be any amino acid
  SITE (897)..(897): Xaa can be any amino acid
  SITE (898)..(898): Xaa can be any amino acid
  SITE (900)..(900): Xaa can be any amino acid except Pro or Gly
  SITE (901)..(901): Xaa can be any amino acid except Pro or Gly
  SITE (903)..(903): Xaa can be any amino acid
  SITE (904)..(904): Xaa can be any amino acid
  SITE (905)..(905): Xaa can be any amino acid
  SITE (907)..(907): Xaa can be any amino acid except Pro or Gly
  SITE (908)..(908): Xaa can be any amino acid except Pro or Gly
  SITE (910)..(910): Xaa can be any amino acid
  SITE (911)..(911): Xaa can be any amino acid
  SITE (912)..(912): Xaa can be any amino acid
  SITE (914)..(914): Xaa can be any amino acid except Pro or Gly
  SITE (915)..(915): Xaa can be any amino acid except Pro or Gly
  SITE (917)..(917): Xaa can be any amino acid
  SITE (918)..(918): Xaa can be any amino acid
  SITE (919)..(919): Xaa can be any amino acid
  SITE (921)..(921): Xaa can be any amino acid except Pro or Gly
  SITE (922)..(922): Xaa can be any amino acid except Pro or Gly
  SITE (924)..(924): Xaa can be any amino acid
  SITE (925)..(925): Xaa can be any amino acid
  SITE (926)..(926): Xaa can be any amino acid
  SITE (928)..(928): Xaa can be any amino acid except Pro or Gly
  SITE (929)..(929): Xaa can be any amino acid except Pro or Gly
  SITE (931)..(931): Xaa can be any amino acid
  SITE (932)..(932): Xaa can be any amino acid
  SITE (933)..(933): Xaa can be any amino acid
  SITE (935)..(935): Xaa can be any amino acid except Pro or Gly
  SITE (936)..(936): Xaa can be any amino acid except Pro or Gly
  SITE (938)..(938): Xaa can be any amino acid
  SITE (939)..(939): Xaa can be any amino acid
  SITE (940)..(940): Xaa can be any amino acid
  SITE (942)..(942): Xaa can be any amino acid except Pro or Gly
  SITE (943)..(943): Xaa can be any amino acid except Pro or Gly
  SITE (945)..(945): Xaa can be any amino acid
  SITE (946)..(946): Xaa can be any amino acid
  SITE (947)..(947): Xaa can be any amino acid
  SITE (949)..(949): Xaa can be any amino acid except Pro or Gly
  SITE (950)..(950): Xaa can be any amino acid except Pro or Gly
  SITE (952)..(952): Xaa can be any amino acid
  SITE (953)..(953): Xaa can be any amino acid
  SITE (954)..(954): Xaa can be any amino acid
  SITE (956)..(956): Xaa can be any amino acid except Pro or Gly
  SITE (957)..(957): Xaa can be any amino acid except Pro or Gly
  SITE (959)..(959): Xaa can be any amino acid
  SITE (960)..(960): Xaa can be any amino acid
  SITE (961)..(961): Xaa can be any amino acid
  SITE (963)..(963): Xaa can be any amino acid except Pro or Gly
  SITE (964)..(964): Xaa can be any amino acid except Pro or Gly
  SITE (966)..(966): Xaa can be any amino acid
  SITE (967)..(967): Xaa can be any amino acid
  SITE (968)..(968): Xaa can be any amino acid
  SITE (970)..(970): Xaa can be any amino acid except Pro or Gly
  SITE (971)..(971): Xaa can be any amino acid except Pro or Gly
  SITE (973)..(973): Xaa can be any amino acid
  SITE (974)..(974): Xaa can be any amino acid
  SITE (975)..(975): Xaa can be any amino acid
  SITE (977)..(977): Xaa can be any amino acid except Pro or Gly
  SITE (978)..(978): Xaa can be any amino acid except Pro or Gly
  SITE (980)..(980): Xaa can be any amino acid
  SITE (981)..(981): Xaa can be any amino acid
  SITE (982)..(982): Xaa can be any amino acid
  SITE (984)..(984): Xaa can be any amino acid except Pro or Gly
  SITE (985)..(985): Xaa can be any amino acid except Pro or Gly
  SITE (987)..(987): Xaa can be any amino acid
  SITE (988)..(988): Xaa can be any amino acid
  SITE (989)..(989): Xaa can be any amino acid
  SITE (991)..(991): Xaa can be any amino acid except Pro or Gly
  SITE (992)..(992): Xaa can be any amino acid except Pro or Gly
  SITE (994)..(994): Xaa can be any amino acid
  SITE (995)..(995): Xaa can be any amino acid
  SITE (996)..(996): Xaa can be any amino acid
  SITE (998)..(998): Xaa can be any amino acid except Pro or Gly
  SITE (999)..(999): Xaa can be any amino acid except Pro or Gly
  SITE (1001)..(1001): Xaa can be any amino acid
  SITE (1002)..(1002): Xaa can be any amino acid
  SITE (1003)..(1003): Xaa can be any amino acid
  SITE (1005)..(1005): Xaa can be any amino acid except Pro or Gly
  SITE (1006)..(1006): Xaa can be any amino acid except Pro or Gly
  SITE (1008)..(1008): Xaa can be any amino acid
  SITE (1009)..(1009): Xaa can be any amino acid
  SITE (1010)..(1010): Xaa can be any amino acid
  SITE (1012)..(1012): Xaa can be any amino acid except Pro or Gly
  SITE (1013)..(1013): Xaa can be any amino acid except Pro or Gly
  SITE (1015)..(1015): Xaa can be any amino acid
  SITE (1016)..(1016): Xaa can be any amino acid
  SITE (1017)..(1017): Xaa can be any amino acid
  SITE (1019)..(1019): Xaa can be any amino acid except Pro or Gly
  SITE (1020)..(1020): Xaa can be any amino acid except Pro or Gly
  SITE (1022)..(1022): Xaa can be any amino acid
  SITE (1023)..(1023): Xaa can be any amino acid
  SITE (1024)..(1024): Xaa can be any amino acid
  SITE (1026)..(1026): Xaa can be any amino acid except Pro or Gly
  SITE (1027)..(1027): Xaa can be any amino acid except Pro or Gly
  SITE (1029)..(1029): Xaa can be any amino acid
  SITE (1030)..(1030): Xaa can be any amino acid
  SITE (1031)..(1031): Xaa can be any amino acid
  SITE (1033)..(1033): Xaa can be any amino acid except Pro or Gly
  SITE (1034)..(1034): Xaa can be any amino acid except Pro or Gly
  SITE (1036)..(1036): Xaa can be any amino acid
  SITE (1037)..(1037): Xaa can be any amino acid
  SITE (1038)..(1038): Xaa can be any amino acid
  SITE (1040)..(1040): Xaa can be any amino acid except Pro or Gly
  SITE (1041)..(1041): Xaa can be any amino acid except Pro or Gly
  SITE (1043)..(1043): Xaa can be any amino acid
  SITE (1044)..(1044): Xaa can be any amino acid
  SITE (1045)..(1045): Xaa can be any amino acid
  SITE (1047)..(1047): Xaa can be any amino acid except Pro or Gly
  SITE (1048)..(1048): Xaa can be any amino acid except Pro or Gly
  SITE (1050)..(1050): Xaa can be any amino acid
  SITE (1051)..(1051): Xaa can be any amino acid
  SITE (1052)..(1052): Xaa can be any amino acid
  SITE (1054)..(1054): Xaa can be any amino acid except Pro or Gly
  SITE (1055)..(1055): Xaa can be any amino acid except Pro or Gly
  SITE (1057)..(1057): Xaa can be any amino acid
  SITE (1058)..(1058): Xaa can be any amino acid
  SITE (1059)..(1059): Xaa can be any amino acid
  SITE (1061)..(1061): Xaa can be any amino acid except Pro or Gly
  SITE (1062)..(1062): Xaa can be any amino acid except Pro or Gly
  SITE (1064)..(1064): Xaa can be any amino acid
  SITE (1065)..(1065): Xaa can be any amino acid
  SITE (1066)..(1066): Xaa can be any amino acid
  SITE (1068)..(1068): Xaa can be any amino acid except Pro or Gly
  SITE (1069)..(1069): Xaa can be any amino acid except Pro or Gly
  SITE (1071)..(1071): Xaa can be any amino acid
  SITE (1072)..(1072): Xaa can be any amino acid
  SITE (1073)..(1073): Xaa can be any amino acid
  SITE (1075)..(1075): Xaa can be any amino acid except Pro or Gly
  SITE (1076)..(1076): Xaa can be any amino acid except Pro or Gly
  SITE (1078)..(1078): Xaa can be any amino acid
  SITE (1079)..(1079): Xaa can be any amino acid
  SITE (1080)..(1080): Xaa can be any amino acid
  SITE (1082)..(1082): Xaa can be any amino acid except Pro or Gly
  SITE (1083)..(1083): Xaa can be any amino acid except Pro or Gly
  SITE (1085)..(1085): Xaa can be any amino acid
  SITE (1086)..(1086): Xaa can be any amino acid
  SITE (1087)..(1087): Xaa can be any amino acid
  SITE (1089)..(1089): Xaa can be any amino acid except Pro or Gly
  SITE (1090)..(1090): Xaa can be any amino acid except Pro or Gly
  SITE (1092)..(1092): Xaa can be any amino acid
  SITE (1093)..(1093): Xaa can be any amino acid
  SITE (1094)..(1094): Xaa can be any amino acid
  SITE (1096)..(1096): Xaa can be any amino acid except Pro or Gly
  SITE (1097)..(1097): Xaa can be any amino acid except Pro or Gly
  SITE (1099)..(1099): Xaa can be any amino acid
  SITE (1100)..(1100): Xaa can be any amino acid
  SITE (1101)..(1101): Xaa can be any amino acid
  SITE (1103)..(1103): Xaa can be any amino acid except Pro or Gly
  SITE (1104)..(1104): Xaa can be any amino acid except Pro or Gly
  SITE (1106)..(1106): Xaa can be any amino acid
  SITE (1107)..(1107): Xaa can be any amino acid
  SITE (1108)..(1108): Xaa can be any amino acid
  SITE (1110)..(1110): Xaa can be any amino acid except Pro or Gly
  SITE (1111)..(1111): Xaa can be any amino acid except Pro or Gly
  SITE (1113)..(1113): Xaa can be any amino acid
  SITE (1114)..(1114): Xaa can be any amino acid
  SITE (1115)..(1115): Xaa can be any amino acid
  SITE (1117)..(1117): Xaa can be any amino acid except Pro or Gly
  SITE (1118)..(1118): Xaa can be any amino acid except Pro or Gly
  SITE (1120)..(1120): Xaa can be any amino acid
XXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGXXXPXXGX

SEQ ID NO: 60 - protein, 1280 aa, Artificial Sequence
  elastin-like polypeptide
  SITE (1)..(1): Xaa can be any amino acid
  SITE (2)..(2): Xaa can be any amino acid
  SITE (4)..(4): Xaa can be any amino acid except Pro or Gly
  SITE (5)..(5): Xaa can be any amino acid except Pro or Gly
  SITE (6)..(6): Xaa can be any amino acid except Pro or Gly
  SITE (8)..(8): Xaa can be any amino acid
  SITE (9)..(9): Xaa can be any amino acid
  SITE (10)..(10): Xaa can be any amino acid
  SITE (12)..(12): Xaa can be any amino acid except Pro or Gly
  SITE (13)..(13): Xaa can be any amino acid except Pro or Gly
  SITE (14)..(14): Xaa can be any amino acid except Pro or Gly
  SITE (16)..(16): Xaa can be any amino acid
  SITE (17)..(17): Xaa can be any amino acid
  SITE (18)..(18): Xaa can be any amino acid
  SITE (20)..(20): Xaa can be any amino acid except Pro or Gly
  SITE (21)..(21): Xaa can be any amino acid except Pro or Gly
  SITE (22)..(22): Xaa can be any amino acid except Pro or Gly
  SITE (24)..(24): Xaa can be any amino acid
  SITE (25)..(25): Xaa can be any amino acid
  SITE (26)..(26): Xaa can be any amino acid
  SITE (28)..(28): Xaa can be any amino acid except Pro or Gly
  SITE (29)..(29): Xaa can be any amino acid except Pro or Gly
  SITE (30)..(30): Xaa can be any amino acid except Pro or Gly
  SITE (32)..(32): Xaa can be any amino acid
  SITE (33)..(33): Xaa can be any amino acid
  SITE (34)..(34): Xaa can be any amino acid
  SITE (36)..(36): Xaa can be any amino acid except Pro or Gly
  SITE (37)..(37): Xaa can be any amino acid except Pro or Gly
  SITE (38)..(38): Xaa can be any amino acid except Pro or Gly
  SITE (40)..(40): Xaa can be any amino acid
  SITE (41)..(41): Xaa can be any amino acid
  SITE (42)..(42): Xaa can be any amino acid
  SITE (44)..(44): Xaa can be any amino acid except Pro or Gly
  SITE (45)..(45): Xaa can be any amino acid except Pro or Gly
  SITE (46)..(46): Xaa can be any amino acid except Pro or Gly
  SITE (48)..(48): Xaa can be any amino acid
  SITE (49)..(49): Xaa can be any amino acid
  SITE (50)..(50): Xaa can be any amino acid
  SITE (52)..(52): Xaa can be any amino acid except Pro or Gly
  SITE (53)..(53): Xaa can be any amino acid except Pro or Gly
  SITE (54)..(54): Xaa can be any amino acid except Pro or Gly
  SITE (56)..(56): Xaa can be any amino acid
  SITE (57)..(57): Xaa can be any amino acid
  SITE (58)..(58): Xaa can be any amino acid
  SITE (60)..(60): Xaa can be any amino acid except Pro or Gly
  SITE (61)..(61): Xaa can be any amino acid except Pro or Gly
  SITE (62)..(62): Xaa can be any amino acid except Pro or Gly
  SITE (64)..(64): Xaa can be any amino acid
  SITE (65)..(65): Xaa can be any amino acid
  SITE (66)..(66): Xaa can be any amino acid
  SITE (68)..(68): Xaa can be any amino acid except Pro or Gly
  SITE (69)..(69): Xaa can be any amino acid except Pro or Gly
  SITE (70)..(70): Xaa can be any amino acid except Pro or Gly
  SITE (72)..(72): Xaa can be any amino acid
  SITE (73)..(73): Xaa can be any amino acid
  SITE (74)..(74): Xaa can be any amino acid
  SITE (76)..(76): Xaa can be any amino acid except Pro or Gly
  SITE (77)..(77): Xaa can be any amino acid except Pro or Gly
  SITE (78)..(78): Xaa can be any amino acid except Pro or Gly
  SITE (80)..(80): Xaa can be any amino acid
  SITE (81)..(1280): May be present or absent in groups of the repeat unit Xaa Xaa Pro Xaa Xaa Xaa Gly Xaa
  SITE (81)..(81): Xaa can be any amino acid
  SITE (82)..(82): Xaa can be any amino acid
  SITE (84)..(84): Xaa can be any amino acid except Pro or Gly
  SITE (85)..(85): Xaa can be any amino acid except Pro or Gly
  SITE (86)..(86): Xaa can be any amino acid except Pro or Gly
  SITE (88)..(88): Xaa can be any amino acid
  SITE (89)..(89): Xaa can be any amino acid
  SITE (90)..(90): Xaa can be any amino acid
  SITE (92)..(92): Xaa can be any amino acid except Pro or Gly
  SITE (93)..(93): Xaa can be any amino acid except Pro or Gly
  SITE (94)..(94): Xaa can be any amino acid except Pro or Gly
  SITE (96)..(96): Xaa can be any amino acid
  SITE (97)..(97): Xaa can be any amino acid
  SITE (98)..(98): Xaa can be any amino acid
  SITE (100)..(100): Xaa can be any amino acid except Pro or Gly
  SITE (101)..(101): Xaa can be any amino acid except Pro or Gly
  SITE (102)..(102): Xaa can be any amino acid except Pro or Gly
  SITE (104)..(104): Xaa can be any amino acid
  SITE (105)..(105): Xaa can be any amino acid
  SITE (106)..(106): Xaa can be any amino acid
  SITE (108)..(108): Xaa can be any amino acid except Pro or Gly
  SITE (109)..(109): Xaa can be any amino acid except Pro or Gly
  SITE (110)..(110): Xaa can be any amino acid except Pro or Gly
  SITE (112)..(112): Xaa can be any amino acid
  SITE (113)..(113): Xaa can be any amino acid
  SITE (114)..(114): Xaa can be any amino acid
  SITE (116)..(116): Xaa can be any amino acid except Pro or Gly
  SITE (117)..(117): Xaa can be any amino acid except Pro or Gly
  SITE (118)..(118): Xaa can be any amino acid except Pro or Gly
  SITE (120)..(120): Xaa can be any amino acid
  SITE (121)..(121): Xaa can be any amino acid
  SITE (122)..(122): Xaa can be any amino acid
  SITE (124)..(124): Xaa can be any amino acid except Pro or Gly
  SITE (125)..(125): Xaa can be any amino acid except Pro or Gly
  SITE (126)..(126): Xaa can be any amino acid except Pro or Gly
  SITE (128)..(128): Xaa can be any amino acid
  SITE (129)..(129): Xaa can be any amino acid
  SITE (130)..(130): Xaa can be any amino acid
  SITE (132)..(132): Xaa can be any amino acid except Pro or Gly
  SITE (133)..(133): Xaa can be any amino acid except Pro or Gly
  SITE (134)..(134): Xaa can be any amino acid except Pro or Gly
  SITE (136)..(136): Xaa can be any amino acid
  SITE (137)..(137): Xaa can be any amino acid
  SITE (138)..(138): Xaa can be any amino acid
  SITE (140)..(140): Xaa can be any amino acid except Pro or Gly
  SITE (141)..(141): Xaa can be any amino acid except Pro or Gly
  SITE (142)..(142): Xaa can be any amino acid except Pro or Gly
  SITE (144)..(144): Xaa can be any amino acid
  SITE (145)..(145): Xaa can be any amino acid
  SITE (146)..(146): Xaa can be any amino acid
  SITE (148)..(148): Xaa can be any amino acid except Pro or Gly
  SITE (149)..(149): Xaa can be any amino acid except Pro or Gly
  SITE (150)..(150): Xaa can be any amino acid except Pro or Gly
  SITE (152)..(152): Xaa can be any amino acid
  SITE (153)..(153): Xaa can be any amino acid
  SITE (154)..(154): Xaa can be any amino acid
  SITE (156)..(156): Xaa can be any amino acid except Pro or Gly
  SITE (157)..(157): Xaa can be any amino acid except Pro or Gly
  SITE (158)..(158): Xaa can be any amino acid except Pro or Gly
  SITE (160)..(160): Xaa can be any amino acid
  SITE (161)..(161): Xaa can be any amino acid
  SITE (162)..(162): Xaa can be any amino acid
  SITE (164)..(164): Xaa can be any amino acid except Pro or Gly
  SITE (165)..(165): Xaa can be any amino acid except Pro or Gly
  SITE (166)..(166): Xaa can be any amino acid except Pro or Gly
  SITE (168)..(168): Xaa can be any amino acid
  SITE (169)..(169): Xaa can be any amino acid
  SITE (170)..(170): Xaa can be any amino acid
  SITE (172)..(172): Xaa can be any amino acid except Pro or Gly
  SITE (173)..(173): Xaa can be any amino acid except Pro or Gly
  SITE (174)..(174): Xaa can be any amino acid except Pro or Gly
  SITE (176)..(176): Xaa can be any amino acid
  SITE (177)..(177): Xaa can be any amino acid
  SITE (178)..(178): Xaa can be any amino acid
  SITE (180)..(180): Xaa can be any amino acid except Pro or Gly
  SITE (181)..(181): Xaa can be any amino acid except Pro or Gly
  SITE (182)..(182): Xaa can be any amino acid except Pro or Gly
  SITE (184)..(184): Xaa can be any amino acid
  SITE (185)..(185): Xaa can be any amino acid
  SITE (186)..(186): Xaa can be any amino acid
  SITE (188)..(188): Xaa can be any amino acid except Pro or Gly
  SITE (189)..(189): Xaa can be any amino acid except Pro or Gly
  SITE (190)..(190): Xaa can be any amino acid except Pro or Gly
  SITE (192)..(192): Xaa can be any amino acid
  SITE (193)..(193): Xaa can be any amino acid
  SITE (194)..(194): Xaa can be any amino acid
  SITE (196)..(196): Xaa can be any amino acid except Pro or Gly
  SITE (197)..(197): Xaa can be any amino acid except Pro or Gly
  SITE (198)..(198): Xaa can be any amino acid except Pro or Gly
  SITE (200)..(200): Xaa can be any amino acid
  SITE (201)..(201): Xaa can be any amino acid
  SITE (202)..(202): Xaa can be any amino acid
  SITE (204)..(204): Xaa can be any amino acid except Pro or Gly
  SITE (205)..(205): Xaa can be any amino acid except Pro or Gly
  SITE (206)..(206): Xaa can be any amino acid except Pro or Gly
  SITE (208)..(208): Xaa can be any amino acid
  SITE (209)..(209): Xaa can be any amino acid
  SITE (210)..(210): Xaa can be any amino acid
  SITE (212)..(212): Xaa can be any amino acid except Pro or Gly
  SITE (213)..(213): Xaa can be any amino acid except Pro or Gly
  SITE (214)..(214): Xaa can be any amino acid except Pro or Gly
  SITE (216)..(216): Xaa can be any amino acid
  SITE (217)..(217): Xaa can be any amino acid
  SITE (218)..(218): Xaa can be any amino acid
  SITE (220)..(220): Xaa can be any amino acid except Pro or Gly
  SITE (221)..(221): Xaa can be any amino acid except Pro or Gly
  SITE (222)..(222): Xaa can be any amino acid except Pro or Gly
  SITE (224)..(224): Xaa can be any amino acid
  SITE (225)..(225): Xaa can be any amino acid
  SITE (226)..(226): Xaa can be any amino acid
  SITE (228)..(228): Xaa can be any amino acid except Pro or Gly
  SITE (229)..(229): Xaa can be any amino acid except Pro or Gly
  SITE (230)..(230): Xaa can be any amino acid except Pro or Gly
  SITE (232)..(232): Xaa can be any amino acid
  SITE (233)..(233): Xaa can be any amino acid
  SITE (234)..(234): Xaa can be any amino acid
  SITE (236)..(236): Xaa can be any amino acid except Pro or Gly
  SITE (237)..(237): Xaa can be any amino acid except Pro or Gly
  SITE (238)..(238): Xaa can be any amino acid except Pro or Gly
  SITE (240)..(240): Xaa can be any amino acid
  SITE (241)..(241): Xaa can be any amino acid
  SITE (242)..(242): Xaa can be any amino acid
  SITE (244)..(244): Xaa can be any amino acid except Pro or Gly
  SITE (245)..(245): Xaa can be any amino acid except Pro or Gly
  SITE (246)..(246): Xaa can be any amino acid except Pro or Gly
  SITE (248)..(248): Xaa can be any amino acid
  SITE (249)..(249): Xaa can be any amino acid
  SITE (250)..(250): Xaa can be any amino acid
  SITE (252)..(252): Xaa can be any amino acid except Pro or Gly
  SITE (253)..(253): Xaa can be any amino acid except Pro or Gly
  SITE (254)..(254): Xaa can be any amino acid except Pro or Gly
  SITE (256)..(256): Xaa can be any amino acid
  SITE (257)..(257): Xaa can be any amino acid
  SITE (258)..(258): Xaa can be any amino acid
  SITE (260)..(260): Xaa can be any amino acid except Pro or Gly
  SITE (261)..(261): Xaa can be any amino acid except Pro or Gly
  SITE (262)..(262): Xaa can be any amino acid except Pro or Gly
  SITE (264)..(264): Xaa can be any amino acid
  SITE (265)..(265): Xaa can be any amino acid
  SITE (266)..(266): Xaa can be any amino acid
  SITE (268)..(268): Xaa can be any amino acid except Pro or Gly
  SITE (269)..(269): Xaa can be any amino acid except Pro or Gly
  SITE (270)..(270): Xaa can be any amino acid except Pro or Gly
  SITE (272)..(272): Xaa can be any amino acid
  SITE (273)..(273): Xaa can be any amino acid
  SITE (274)..(274): Xaa can be any amino acid
  SITE (276)..(276): Xaa can be any amino acid except Pro or Gly
  SITE (277)..(277): Xaa can be any amino acid except Pro or Gly
  SITE (278)..(278): Xaa can be any amino acid except Pro or Gly
  SITE (280)..(280): Xaa can be any amino acid
  SITE (281)..(281): Xaa can be any amino acid
  SITE (282)..(282): Xaa can be any amino acid
  SITE (284)..(284): Xaa can be any amino acid except Pro or Gly
  SITE (285)..(285): Xaa can be any amino acid except Pro or Gly
  SITE (286)..(286): Xaa can be any amino acid except Pro or Gly
  SITE (288)..(288): Xaa can be any amino acid
  SITE (289)..(289): Xaa can be any amino acid
  SITE (290)..(290): Xaa can be any amino acid
  SITE (292)..(292): Xaa can be any amino acid except Pro or Gly
  SITE (293)..(293): Xaa can be any amino acid except Pro or Gly
  SITE (294)..(294): Xaa can be any amino acid except Pro or Gly
  SITE (296)..(296): Xaa can be any amino acid
  SITE (297)..(297): Xaa can be any amino acid
  SITE (298)..(298): Xaa can be any amino acid
  SITE (300)..(300): Xaa can be any amino acid except Pro or Gly
  SITE (301)..(301): Xaa can be any amino acid except Pro or Gly
  SITE (302)..(302): Xaa can be any amino acid except Pro or Gly
  SITE (304)..(304): Xaa can be any amino acid
  SITE (305)..(305): Xaa can be any amino acid
  SITE (306)..(306): Xaa can be any amino acid
  SITE (308)..(308): Xaa can be any amino acid except Pro or Gly
  SITE (309)..(309): Xaa can be any amino acid except Pro or Gly
  SITE (310)..(310): Xaa can be any amino acid except Pro or Gly
  SITE (312)..(312): Xaa can be any amino acid
  SITE (313)..(313): Xaa can be any amino acid
  SITE (314)..(314): Xaa can be any amino acid
  SITE (316)..(316): Xaa can be any amino acid except Pro or Gly
  SITE (317)..(317): Xaa can be any amino acid except Pro or Gly
  SITE (318)..(318): Xaa can be any amino acid except Pro or Gly
  SITE (320)..(320): Xaa can be any amino acid
  SITE (321)..(321): Xaa can be any amino acid
  SITE (322)..(322): Xaa can be any amino acid
  SITE (324)..(324): Xaa can be any amino acid except Pro or Gly
  SITE (325)..(325): Xaa can be any amino acid except Pro or Gly
  SITE (326)..(326): Xaa can be any amino acid except Pro or Gly
  SITE (328)..(328): Xaa can be any amino acid
  SITE (329)..(329): Xaa can be any amino acid
  SITE (330)..(330): Xaa can be any amino acid
  SITE (332)..(332): Xaa can be any amino acid except Pro or Gly
  SITE (333)..(333): Xaa can be any amino acid except Pro or Gly
  SITE (334)..(334): Xaa can be any amino acid except Pro or Gly
  SITE (336)..(336): Xaa can be any amino acid
  SITE (337)..(337): Xaa can be any amino acid
  SITE (338)..(338): Xaa can be any amino acid
  SITE (340)..(340): Xaa can be any amino acid except Pro or Gly
  SITE (341)..(341): Xaa can be any amino acid except Pro or Gly
  SITE (342)..(342): Xaa can be any amino acid except Pro or Gly
  SITE (344)..(344): Xaa can be any amino acid
  SITE (345)..(345): Xaa can be any amino acid
  SITE (346)..(346): Xaa can be any amino acid
  SITE (348)..(348): Xaa can be any amino acid except Pro or Gly
  SITE (349)..(349): Xaa can be any amino acid except Pro or Gly
  SITE (350)..(350): Xaa can be any amino acid except Pro or Gly
  SITE (352)..(352): Xaa can be any amino acid
  SITE (353)..(353): Xaa can be any amino acid
  SITE (354)..(354): Xaa can be any amino acid
  SITE (356)..(356): Xaa can be any amino acid except Pro or Gly
  SITE (357)..(357): Xaa can be any amino acid except Pro or Gly
  SITE (358)..(358): Xaa can be any amino acid except Pro or Gly
  SITE (360)..(360): Xaa can be any amino acid
  SITE (361)..(361): Xaa can be any amino acid
  SITE (362)..(362): Xaa can be any amino acid
  SITE (364)..(364): Xaa can be any amino acid except Pro or Gly
  SITE (365)..(365): Xaa can be any amino acid except Pro or Gly
  SITE (366)..(366): Xaa can be any amino acid except Pro or Gly
  SITE (368)..(368): Xaa can be any amino acid
  SITE (369)..(369): Xaa can be any amino acid
  SITE (370)..(370): Xaa can be any amino acid
  SITE (372)..(372): Xaa can be any amino acid except Pro or Gly
  SITE (373)..(373): Xaa can be any amino acid except Pro or Gly
  SITE (374)..(374): Xaa can be any amino acid except Pro or Gly
  SITE (376)..(376): Xaa can be any amino acid
  SITE (377)..(377): Xaa can be any amino acid
  SITE (378)..(378): Xaa can be any amino acid
  SITE (380)..(380): Xaa can be any amino acid except Pro or Gly
  SITE (381)..(381): Xaa can be any amino acid except Pro or Gly
  SITE (382)..(382): Xaa can be any amino acid except Pro or Gly
  SITE (384)..(384): Xaa can be any amino acid
  SITE (385)..(385): Xaa can be any amino acid
  SITE (386)..(386): Xaa can be any amino acid
  SITE (388)..(388): Xaa can be any amino acid except Pro or Gly
  SITE (389)..(389): Xaa can be any amino acid except Pro or Gly
  SITE (390)..(390): Xaa can be any amino acid except Pro or Gly
  SITE (392)..(392): Xaa can be any amino acid
  SITE (393)..(393): Xaa can be any amino acid
  SITE (394)..(394): Xaa can be any amino acid
  SITE (396)..(396): Xaa can be any amino acid except Pro or Gly
  SITE (397)..(397): Xaa can be any amino acid except Pro or Gly
  SITE (398)..(398): Xaa can be any amino acid except Pro or Gly
  SITE (400)..(400): Xaa can be any amino acid
  SITE (401)..(401): Xaa can be any amino acid
  SITE (402)..(402): Xaa can be any amino acid
  SITE (404)..(404): Xaa can be any amino acid except Pro or Gly
  SITE (405)..(405): Xaa can be any amino acid except Pro or Gly
  SITE (406)..(406): Xaa can be any amino acid except Pro or Gly
  SITE (408)..(408): Xaa can be any amino acid
  SITE (409)..(409): Xaa can be any amino acid
  SITE (410)..(410): Xaa can be any amino acid
  SITE (412)..(412): Xaa can be any amino acid except Pro or Gly
  SITE (413)..(413): Xaa can be any amino acid except Pro or Gly
  SITE (414)..(414): Xaa can be any amino acid except Pro or Gly
  SITE (416)..(416): Xaa can be any amino acid
  SITE (417)..(417): Xaa can be any amino acid
  SITE (418)..(418): Xaa can be any amino acid
  SITE (420)..(420): Xaa can be any amino acid except Pro or Gly
  SITE (421)..(421): Xaa can be any amino acid except Pro or Gly
  SITE (422)..(422): Xaa can be any amino acid except Pro or Gly
  SITE (424)..(424): Xaa can be any amino acid
  SITE (425)..(425): Xaa can be any amino acid
  SITE (426)..(426): Xaa can be any amino acid
  SITE (428)..(428): Xaa can be any amino acid except Pro or Gly
  SITE (429)..(429): Xaa can be any amino acid except Pro or Gly
  SITE (430)..(430): Xaa can be any amino acid except Pro or Gly
  SITE (432)..(432): Xaa can be any amino acid
  SITE (433)..(433): Xaa can be any amino acid
  SITE (434)..(434): Xaa can be any amino acid
  SITE (436)..(436): Xaa can be any amino acid except Pro or Gly
  SITE (437)..(437): Xaa can be any amino acid except Pro or Gly
  SITE (438)..(438): Xaa can be any amino acid except Pro or Gly
  SITE (440)..(440): Xaa can be any amino acid
  SITE (441)..(441): Xaa can be any amino acid
  SITE (442)..(442): Xaa can be any amino acid
  SITE (444)..(444): Xaa can be any amino acid except Pro or Gly
  SITE (445)..(445): Xaa can be any amino acid except Pro or Gly
  SITE (446)..(446): Xaa can be any amino acid except Pro or Gly
  SITE (448)..(448): Xaa can be any amino acid
  SITE (449)..(449): Xaa can be any amino acid
  SITE (450)..(450): Xaa can be any amino acid
  SITE (452)..(452): Xaa can be any amino acid except Pro or Gly
  SITE (453)..(453): Xaa can be any amino acid except Pro or Gly
  SITE (454)..(454): Xaa can be any amino acid except Pro or Gly
  SITE (456)..(456): Xaa can be any amino acid
  SITE (457)..(457): Xaa can be any amino acid
  SITE (458)..(458): Xaa can be any amino acid
  SITE (460)..(460): Xaa can be any amino acid except Pro or Gly
  SITE (461)..(461): Xaa can be any amino acid except Pro or Gly
  SITE (462)..(462): Xaa can be any amino acid except Pro or Gly
  SITE (464)..(464): Xaa can be any amino acid
  SITE (465)..(465): Xaa can be any amino acid
  SITE (466)..(466): Xaa can be any amino acid
  SITE (468)..(468): Xaa can be any amino acid except Pro or Gly
  SITE (469)..(469): Xaa can be any amino acid except Pro or Gly
  SITE (470)..(470): Xaa can be any amino acid except Pro or Gly
  SITE (472)..(472): Xaa can be any amino acid
  SITE (473)..(473): Xaa can be any amino acid
  SITE (474)..(474): Xaa can be any amino acid
  SITE (476)..(476): Xaa can be any amino acid except Pro or Gly
  SITE (477)..(477): Xaa can be any amino acid except Pro or Gly
  SITE (478)..(478): Xaa can be any amino acid except Pro or Gly
  SITE (480)..(480): Xaa can be any amino acid
  SITE (481)..(481): Xaa can be any amino acid
  SITE (482)..(482): Xaa can be any amino acid
  SITE (484)..(484): Xaa can be any amino acid except Pro or Gly
  SITE (485)..(485): Xaa can be any amino acid except Pro or Gly
  SITE (486)..(486): Xaa can be any amino acid except Pro or Gly
  SITE (488)..(488): Xaa can be any amino acid
  SITE (489)..(489): Xaa can be any amino acid
  SITE (490)..(490): Xaa can be any amino acid
  SITE (492)..(492): Xaa can be any amino acid except Pro or Gly
  SITE (493)..(493): Xaa can be any amino acid except Pro or Gly
  SITE (494)..(494): Xaa can be any amino acid except Pro or Gly
  SITE (496)..(496): Xaa can be any amino acid
  SITE (497)..(497): Xaa can be any amino acid
  SITE (498)..(498): Xaa can be any amino acid
  SITE (500)..(500): Xaa can be any amino acid except Pro or Gly
  SITE (501)..(501): Xaa can be any amino acid except Pro or Gly
  SITE (502)..(502): Xaa can be any amino acid except Pro or Gly
  SITE (504)..(504): Xaa can be any amino acid
  SITE (505)..(505): Xaa can be any amino acid
  SITE (506)..(506): Xaa can be any amino acid
  SITE (508)..(508): Xaa can be any amino acid except Pro or Gly
  SITE (509)..(509): Xaa can be any amino acid except Pro or Gly
  SITE (510)..(510): Xaa can be any amino acid except Pro or Gly
  SITE (512)..(512): Xaa can be any amino acid
  SITE (513)..(513): Xaa can be any amino acid
  SITE (514)..(514): Xaa can be any amino acid
  SITE (516)..(516): Xaa can be any amino acid except Pro or Gly
  SITE (517)..(517): Xaa can be any amino acid except Pro or Gly
  SITE (518)..(518): Xaa can be any amino acid except Pro or Gly
  SITE (520)..(520): Xaa can be any amino acid
  SITE (521)..(521): Xaa can be any amino acid
  SITE (522)..(522): Xaa can be any amino acid
  SITE (524)..(524): Xaa can be any amino acid except Pro or Gly
  SITE (525)..(525): Xaa can be any amino acid except Pro or Gly
  SITE (526)..(526): Xaa can be any amino acid except Pro or Gly
  SITE (528)..(528): Xaa can be any amino acid
  SITE (529)..(529): Xaa can be any amino acid
  SITE (530)..(530): Xaa can be any amino acid
  SITE (532)..(532): Xaa can be any amino acid except Pro or Gly
  SITE (533)..(533): Xaa can be any amino acid except Pro or Gly
  SITE (534)..(534): Xaa can be any amino acid except Pro or Gly
  SITE (536)..(536): Xaa can be any amino acid
  SITE (537)..(537): Xaa can be any amino acid
  SITE (538)..(538): Xaa can be any amino acid
  SITE (540)..(540): Xaa can be any amino acid except Pro or Gly
  SITE (541)..(541): Xaa can be any amino acid except Pro or Gly
  SITE (542)..(542): Xaa can be any amino acid except Pro or Gly
  SITE (544)..(544): Xaa can be any amino acid
  SITE (545)..(545): Xaa can be any amino acid
  SITE (546)..(546): Xaa can be any amino acid
  SITE (548)..(548): Xaa can be any amino acid except Pro or Gly
  SITE (549)..(549): Xaa can be any amino acid except Pro or Gly
  SITE (550)..(550): Xaa can be any amino acid except Pro or Gly
  SITE (552)..(552): Xaa can be any amino acid
  SITE (553)..(553): Xaa can be any amino acid
  SITE (554)..(554): Xaa can be any amino acid
  SITE (556)..(556): Xaa can be any amino acid except Pro or Gly
  SITE (557)..(557): Xaa can be any amino acid except Pro or Gly
  SITE (558)..(558): Xaa can be any amino acid except Pro or Gly
  SITE (560)..(560): Xaa can be any amino acid
  SITE (561)..(561): Xaa can be any amino acid
  SITE (562)..(562): Xaa can be any amino acid
  SITE (564)..(564): Xaa can be any amino acid except Pro or Gly
  SITE (565)..(565): Xaa can be any amino acid except Pro or Gly
  SITE (566)..(566): Xaa can be any amino acid except Pro or Gly
  SITE (568)..(568): Xaa can be any amino acid
  SITE (569)..(569): Xaa can be any amino acid
  SITE (570)..(570): Xaa can be any amino acid
  SITE (572)..(572): Xaa can be any amino acid except Pro or Gly
  SITE (573)..(573): Xaa can be any amino acid except Pro or Gly
  SITE (574)..(574): Xaa can be any amino acid except Pro or Gly
  SITE (576)..(576): Xaa can be any amino acid
  SITE (577)..(577): Xaa can be any amino acid
  SITE (578)..(578): Xaa can be any amino acid
  SITE (580)..(580): Xaa can be any amino acid except Pro or Gly
  SITE (581)..(581): Xaa can be any amino acid except Pro or Gly
  SITE (582)..(582): Xaa can be any amino acid except Pro or Gly
  SITE (584)..(584): Xaa can be any amino acid
  SITE (585)..(585): Xaa can be any amino acid
  SITE (586)..(586): Xaa can be any amino acid
  SITE (588)..(588): Xaa can be any amino acid except Pro or Gly
  SITE (589)..(589): Xaa can be any amino acid except Pro or Gly
  SITE (590)..(590): Xaa can be any amino acid except Pro or Gly
  SITE (592)..(592): Xaa can be any amino acid
  SITE (593)..(593): Xaa can be any amino acid
  SITE (594)..(594): Xaa can be any amino acid
  SITE (596)..(596): Xaa can be any amino acid except Pro or Gly
  SITE (597)..(597): Xaa can be any amino acid except Pro or Gly
  SITE (598)..(598): Xaa can be any amino acid except Pro or Gly
  SITE (600)..(600): Xaa can be any amino acid
  SITE (601)..(601): Xaa can be any amino acid
  SITE (602)..(602): Xaa can be any amino acid
  SITE (604)..(604): Xaa can be any amino acid except Pro or Gly
  SITE (605)..(605): Xaa can be any amino acid except Pro or Gly
  SITE (606)..(606): Xaa can be any amino acid except Pro or Gly
  SITE (608)..(608): Xaa can be any amino acid
  SITE (609)..(609): Xaa can be any amino acid
  SITE (610)..(610): Xaa can be any amino acid
  SITE (612)..(612): Xaa can be any amino acid except Pro or Gly
  SITE (613)..(613): Xaa can be any amino acid except Pro or Gly
  SITE (614)..(614): Xaa can be any amino acid except Pro or Gly
  SITE (616)..(616): Xaa can be any amino acid
  SITE (617)..(617): Xaa can be any amino acid
  SITE (618)..(618): Xaa can be any amino acid
  SITE (620)..(620): Xaa can be any amino acid except Pro or Gly
  SITE (621)..(621): Xaa can be any amino acid except Pro or Gly
  SITE (622)..(622): Xaa can be any amino acid except Pro or Gly
  SITE (624)..(624): Xaa can be any amino acid
  SITE (625)..(625): Xaa can be any amino acid
  SITE (626)..(626): Xaa can be any amino acid
  SITE (628)..(628): Xaa can be any amino acid except Pro or Gly
  SITE (629)..(629): Xaa can be any amino acid except Pro or Gly
  SITE (630)..(630): Xaa can be any amino acid except Pro or Gly
  SITE (632)..(632): Xaa can be any amino acid
  SITE (633)..(633): Xaa can be any amino acid
  SITE (634)..(634): Xaa can be any amino acid
  SITE (636)..(636): Xaa can be any amino acid except Pro or Gly
  SITE (637)..(637): Xaa can be any amino acid except Pro or Gly
  SITE (638)..(638): Xaa can be any amino acid except Pro or Gly
  SITE (640)..(640): Xaa can be any amino acid
  SITE (641)..(641): Xaa can be any amino acid
  SITE (642)..(642): Xaa can be any amino acid
  SITE (644)..(644): Xaa can be any amino acid except Pro or Gly
  SITE (645)..(645): Xaa can be any amino acid except Pro or Gly
  SITE (646)..(646): Xaa can be any amino acid except Pro or Gly
  SITE (648)..(648): Xaa can be any amino acid
  SITE (649)..(649): Xaa can be any amino acid
  SITE (650)..(650): Xaa can be any amino acid
  SITE (652)..(652): Xaa can be any amino acid except Pro or Gly
  SITE (653)..(653): Xaa can be any amino acid except Pro or Gly
  SITE (654)..(654): Xaa can be any amino acid except Pro or Gly
  SITE (656)..(656): Xaa can be any amino acid
  SITE (657)..(657): Xaa can be any amino acid
  SITE (658)..(658): Xaa can be any amino acid
  SITE (660)..(660): Xaa can be any amino acid except Pro or Gly
  SITE (661)..(661): Xaa can be any amino acid except Pro or Gly
  SITE (662)..(662): Xaa can be any amino acid except Pro or Gly
  SITE (664)..(664): Xaa can be any amino acid
  SITE (665)..(665): Xaa can be any amino acid
  SITE (666)..(666): Xaa can be any amino acid
  SITE (668)..(668): Xaa can be any amino acid except Pro or Gly
  SITE (669)..(669): Xaa can be any amino acid except Pro or Gly
  SITE (670)..(670): Xaa can be any amino acid except Pro or Gly
  SITE (672)..(672): Xaa can be any amino acid
  SITE (673)..(673): Xaa can be any amino acid
  SITE (674)..(674): Xaa can be any amino acid
  SITE (676)..(676): Xaa can be any amino acid except Pro or Gly
  SITE (677)..(677): Xaa can be any amino acid except Pro or Gly
  SITE (678)..(678): Xaa can be any amino acid except Pro or Gly
  SITE (680)..(680): Xaa can be any amino acid
  SITE (681)..(681): Xaa can be any amino acid
  SITE (682)..(682): Xaa can be any amino acid
  SITE (684)..(684): Xaa can be any amino acid except Pro or Gly
  SITE (685)..(685): Xaa can be any amino acid except Pro or Gly
  SITE (686)..(686): Xaa can be any amino acid except Pro or Gly
  SITE (688)..(688): Xaa can be any amino acid
  SITE (689)..(689): Xaa can be any amino acid
  SITE (690)..(690): Xaa can be any amino acid
  SITE (692)..(692): Xaa can be any amino acid except Pro or Gly
  SITE (693)..(693): Xaa can be any amino acid except Pro or Gly
  SITE (694)..(694): Xaa can be any amino acid except Pro or Gly
  SITE (696)..(696): Xaa can be any amino acid
  SITE (697)..(697): Xaa can be any amino acid
  SITE (698)..(698): Xaa can be any amino acid
  SITE (700)..(700): Xaa can be any amino acid except Pro or Gly
  SITE (701)..(701): Xaa can be any amino acid except Pro or Gly
  SITE (702)..(702): Xaa can be any amino acid except Pro or Gly
  SITE (704)..(704): Xaa can be any amino acid
  SITE (705)..(705): Xaa can be any amino acid
  SITE (706)..(706): Xaa can be any amino acid
  SITE (708)..(708): Xaa can be any amino acid except Pro or Gly
  SITE (709)..(709): Xaa can be any amino acid except Pro or Gly
  SITE (710)..(710): Xaa can be any amino acid except Pro or Gly
  SITE (712)..(712): Xaa can be any amino acid
  SITE (713)..(713): Xaa can be any amino acid
  SITE (714)..(714): Xaa can be any amino acid
  SITE (716)..(716): Xaa can be any amino acid except Pro or Gly
  SITE (717)..(717): Xaa can be any amino acid except Pro or Gly
  SITE (718)..(718): Xaa can be any amino acid except Pro or Gly
  SITE (720)..(720): Xaa can be any amino acid
  SITE (721)..(721): Xaa can be any amino acid
  SITE (722)..(722): Xaa can be any amino acid
  SITE (724)..(724): Xaa can be any amino acid except Pro or Gly
  SITE (725)..(725): Xaa can be any amino acid except Pro or Gly
  SITE (726)..(726): Xaa can be any amino acid except Pro or Gly
  SITE (728)..(728): Xaa can be any amino acid
  SITE (729)..(729): Xaa can be any amino acid
  SITE (730)..(730): Xaa can be any amino acid
  SITE (732)..(732): Xaa can be any amino acid except Pro or Gly
  SITE (733)..(733): Xaa can be any amino acid except Pro or Gly
  SITE (734)..(734): Xaa can be any amino acid except Pro or Gly
  SITE (736)..(736): Xaa can be any amino acid
  SITE (737)..(737): Xaa can be any amino acid
  SITE (738)..(738): Xaa can be any amino acid
  SITE (740)..(740): Xaa can be any amino acid except Pro or Gly
  SITE (741)..(741): Xaa can be any amino acid except Pro or Gly
  SITE (742)..(742): Xaa can be any amino acid except Pro or Gly
  SITE (744)..(744): Xaa can be any amino acid
  SITE (745)..(745): Xaa can be any amino acid
  SITE (746)..(746): Xaa can be any amino acid
  SITE (748)..(748): Xaa can be any amino acid except Pro or Gly
  SITE (749)..(749): Xaa can be any amino acid except Pro or Gly
  SITE (750)..(750): Xaa can be any amino acid except Pro or Gly
  SITE (752)..(752): Xaa can be any amino acid
  SITE (753)..(753): Xaa can be any amino acid
  SITE (754)..(754): Xaa can be any amino acid
  SITE (756)..(756): Xaa can be any amino acid except Pro or Gly
  SITE (757)..(757): Xaa can be any amino acid except Pro or Gly
  SITE (758)..(758): Xaa can be any amino acid except Pro or Gly
  SITE (760)..(760): Xaa can be any amino acid
  SITE (761)..(761): Xaa can be any amino acid
  SITE (762)..(762): Xaa can be any amino acid
  SITE (764)..(764): Xaa can be any amino acid except Pro or Gly
  SITE (765)..(765): Xaa can be any amino acid except Pro or Gly
  SITE (766)..(766): Xaa can be any amino acid except Pro or Gly
  SITE (768)..(768): Xaa can be any amino acid
  SITE (769)..(769): Xaa can be any amino acid
  SITE (770)..(770): Xaa can be any amino acid
  SITE (772)..(772): Xaa can be any amino acid except Pro or Gly
  SITE (773)..(773): Xaa can be any amino acid except Pro or Gly
  SITE (774)..(774): Xaa can be any amino acid except Pro or Gly
  SITE (776)..(776): Xaa can be any amino acid
  SITE (777)..(777): Xaa can be any amino acid
  SITE (778)..(778): Xaa can be any amino acid
  SITE (780)..(780): Xaa can be any amino acid except Pro or Gly
  SITE (781)..(781): Xaa can be any amino acid except Pro or Gly
  SITE (782)..(782): Xaa can be any amino acid except Pro or Gly
  SITE (784)..(784): Xaa can be any amino acid
  SITE (785)..(785): Xaa can be any amino acid
  SITE (786)..(786): Xaa can be any amino acid
  SITE (788)..(788): Xaa can be any amino acid except Pro or Gly
  SITE (789)..(789): Xaa can be any amino acid except Pro or Gly
  SITE (790)..(790): Xaa can be any amino acid except Pro or Gly
  SITE (792)..(792): Xaa can be any amino acid
  SITE (793)..(793): Xaa can be any amino acid
  SITE (794)..(794): Xaa can be any amino acid
  SITE (796)..(796): Xaa can be any amino acid except Pro or Gly
  SITE (797)..(797): Xaa can be any amino acid except Pro or Gly
  SITE (798)..(798): Xaa can be any amino acid except Pro or Gly
  SITE (800)..(800): Xaa can be any amino acid
  SITE (801)..(801): Xaa can be any amino acid
  SITE (802)..(802): Xaa can be any amino acid
  SITE (804)..(804): Xaa can be any amino acid except Pro or Gly
  SITE (805)..(805): Xaa can be any amino acid except Pro or Gly
  SITE (806)..(806): Xaa can be any amino acid except Pro or Gly
  SITE (808)..(808): Xaa can be any amino acid
  SITE (809)..(809): Xaa can be any amino acid
  SITE (810)..(810): Xaa can be any amino acid
  SITE (812)..(812): Xaa can be any amino acid except Pro or Gly
  SITE (813)..(813): Xaa can be any amino acid except Pro or Gly
  SITE (814)..(814): Xaa can be any amino acid except Pro or Gly
  SITE (816)..(816): Xaa can be any amino acid
  SITE (817)..(817): Xaa can be any amino acid
  SITE (818)..(818): Xaa can be any amino acid
  SITE (820)..(820): Xaa can be any amino acid except Pro or Gly
  SITE (821)..(821): Xaa can be any amino acid except Pro or Gly
  SITE (822)..(822): Xaa can be any amino acid except Pro or Gly
  SITE (824)..(824): Xaa can be any amino acid
  SITE (825)..(825): Xaa can be any amino acid
  SITE (826)..(826): Xaa can be any amino acid
  SITE (828)..(828): Xaa can be any amino acid except Pro or Gly
  SITE (829)..(829): Xaa can be any amino acid except Pro or Gly
  SITE (830)..(830): Xaa can be any amino acid except Pro or Gly
  SITE (832)..(832): Xaa can be any amino acid
  SITE (833)..(833): Xaa can be any amino acid
  SITE (834)..(834): Xaa can be any amino acid
  SITE (836)..(836): Xaa can be any amino acid except Pro or Gly
  SITE (837)..(837): Xaa can be any amino acid except Pro or Gly
  SITE (838)..(838): Xaa can be any amino acid except Pro or Gly
  SITE (840)..(840): Xaa can be any amino acid
  SITE (841)..(841): Xaa can be any amino acid
  SITE (842)..(842): Xaa can be any amino acid
  SITE (844)..(844): Xaa can be any amino acid except Pro or Gly
  SITE (845)..(845): Xaa can be any amino acid except Pro or Gly
  SITE (846)..(846): Xaa can be any amino acid except Pro or Gly
  SITE (848)..(848): Xaa can be any amino acid
  SITE (849)..(849): Xaa can be any amino acid
  SITE (850)..(850): Xaa can be any amino acid
  SITE (852)..(852): Xaa can be any amino acid except Pro or Gly
  SITE (853)..(853): Xaa can be any amino acid except Pro or Gly
  SITE (854)..(854): Xaa can be any amino acid except Pro or Gly
  SITE (856)..(856): Xaa can be any amino acid
  SITE (857)..(857): Xaa can be any amino acid
  SITE (858)..(858): Xaa can be any amino acid
  SITE (860)..(860): Xaa can be any amino acid except Pro or Gly
  SITE (861)..(861): Xaa can be any amino acid except Pro or Gly
  SITE (862)..(862): Xaa can be any amino acid except Pro or Gly
  SITE (864)..(864): Xaa can be any amino acid
  SITE (865)..(865): Xaa can be any amino acid
  SITE (866)..(866): Xaa can be any amino acid
  SITE (868)..(868): Xaa can be any amino acid except Pro or Gly
  SITE (869)..(869): Xaa can be any amino acid except Pro or Gly
  SITE (870)..(870): Xaa can be any amino acid except Pro or Gly
  SITE (872)..(872): Xaa can be any amino acid
  SITE (873)..(873): Xaa can be any amino acid
  SITE (874)..(874): Xaa can be any amino acid
  SITE (876)..(876): Xaa can be any amino acid except Pro or Gly
  SITE (877)..(877): Xaa can be any amino acid except Pro or Gly
  SITE (878)..(878): Xaa can be any amino acid except Pro or Gly
  SITE (880)..(880): Xaa can be any amino acid
  SITE (881)..(881): Xaa can be any amino acid
  SITE (882)..(882): Xaa can be any amino acid
  SITE (884)..(884): Xaa can be any amino acid except Pro or Gly
  SITE (885)..(885): Xaa can be any amino acid except Pro or Gly
  SITE (886)..(886): Xaa can be any amino acid except Pro or Gly
  SITE (888)..(888): Xaa can be any amino acid
  SITE (889)..(889): Xaa can be any amino acid
  SITE (890)..(890): Xaa can be any amino acid
  SITE (892)..(892): Xaa can be any amino acid except Pro or Gly
  SITE (893)..(893): Xaa can be any amino acid except Pro or Gly
  SITE (894)..(894): Xaa can be any amino acid except Pro or Gly
  SITE (896)..(896): Xaa can be any amino acid
  SITE (897)..(897): Xaa can be any amino acid
  SITE (898)..(898): Xaa can be any amino acid
  SITE (900)..(900): Xaa can be any amino acid except Pro or Gly
  SITE (901)..(901): Xaa can be any amino acid except Pro or Gly
  SITE (902)..(902): Xaa can be any amino acid except Pro or Gly
  SITE (904)..(904): Xaa can be any amino acid
  SITE (905)..(905): Xaa can be any amino acid
  SITE (906)..(906): Xaa can be any amino acid
  SITE (908)..(908): Xaa can be any amino acid except Pro or Gly
  SITE (909)..(909): Xaa can be any amino acid except Pro or Gly
  SITE (910)..(910): Xaa can be any amino acid except Pro or Gly
  SITE (912)..(912): Xaa can be any amino acid
  SITE (913)..(913): Xaa can be any amino acid
  SITE (914)..(914): Xaa can be any amino acid
  SITE (916)..(916): Xaa can be any amino acid except Pro or Gly
  SITE (917)..(917): Xaa can be any amino acid except Pro or Gly
  SITE (918)..(918): Xaa can be any amino acid except Pro or Gly
  SITE (920)..(920): Xaa can be any amino acid
  SITE (921)..(921): Xaa can be any amino acid
  SITE (922)..(922): Xaa can be any amino acid
  SITE (924)..(924): Xaa can be any amino acid except Pro or Gly
  SITE (925)..(925): Xaa can be any amino acid except Pro or Gly
  SITE (926)..(926): Xaa can be any amino acid except Pro or Gly
  SITE (928)..(928): Xaa can be any amino acid
  SITE (929)..(929): Xaa can be any amino acid
  SITE (930)..(930): Xaa can be any amino acid
  SITE (932)..(932): Xaa can be any amino acid except Pro or Gly
  SITE (933)..(933): Xaa can be any amino acid except Pro or Gly
  SITE (934)..(934): Xaa can be any amino acid except Pro or Gly
  SITE (936)..(936): Xaa can be any amino acid
  SITE (937)..(937): Xaa can be any amino acid
  SITE (938)..(938): Xaa can be any amino acid
  SITE (940)..(940): Xaa can be any amino acid except Pro or Gly
  SITE (941)..(941): Xaa can be any amino acid except Pro or Gly
  SITE (942)..(942): Xaa can be any amino acid except Pro or Gly
  SITE (944)..(944): Xaa can be any amino acid
  SITE (945)..(945): Xaa can be any amino acid
  SITE (946)..(946): Xaa can be any amino acid
  SITE (948)..(948): Xaa can be any amino acid except Pro or Gly
  SITE (949)..(949): Xaa can be any amino acid except Pro or Gly
  SITE (950)..(950): Xaa can be any amino acid except Pro or Gly
  SITE (952)..(952): Xaa can be any amino acid
  SITE (953)..(953): Xaa can be any amino acid
  SITE (954)..(954): Xaa can be any amino acid
  SITE (956)..(956): Xaa can be any amino acid except Pro or Gly
  SITE (957)..(957): Xaa can be any amino acid except Pro or Gly
  SITE (958)..(958): Xaa can be any amino acid except Pro or Gly
  SITE (960)..(960): Xaa can be any amino acid
  SITE (961)..(961): Xaa can be any amino acid
  SITE (962)..(962): Xaa can be any amino acid
  SITE (964)..(964): Xaa can be any amino acid except Pro or Gly
  SITE (965)..(965): Xaa can be any amino acid except Pro or Gly
  SITE (966)..(966): Xaa can be any amino acid except Pro or Gly
  SITE (968)..(968): Xaa can be any amino acid
  SITE (969)..(969): Xaa can be any amino acid
  SITE (970)..(970): Xaa can be any amino acid
  SITE (972)..(972): Xaa can be any amino acid except Pro or Gly
  SITE (973)..(973): Xaa can be any amino acid except Pro or Gly
  SITE (974)..(974): Xaa can be any amino acid except Pro or Gly
  SITE (976)..(976): Xaa can be any amino acid
  SITE (977)..(977): Xaa can be any amino acid
  SITE (978)..(978): Xaa can be any amino acid
  SITE (980)..(980): Xaa can be any amino acid except Pro or Gly
  SITE (981)..(981): Xaa can be any amino acid except Pro or Gly
  SITE (982)..(982): Xaa can be any amino acid except Pro or Gly
  SITE (984)..(984): Xaa can be any amino acid
  SITE (985)..(985): Xaa can be any amino acid
  SITE (986)..(986): Xaa can be any amino acid
  SITE (988)..(988): Xaa can be any amino acid except Pro or Gly
  SITE (989)..(989): Xaa can be any amino acid except Pro or Gly
  SITE (990)..(990): Xaa can be any amino acid except Pro or Gly
  SITE (992)..(992): Xaa can be any amino acid
  SITE (993)..(993): Xaa can be any amino acid
  SITE (994)..(994): Xaa can be any amino acid
  SITE (996)..(996): Xaa can be any amino acid except Pro or Gly
  SITE (997)..(997): Xaa can be any amino acid except Pro or Gly
  SITE (998)..(998): Xaa can be any amino acid except Pro or Gly
  SITE (1000)..(1000): Xaa can be any amino acid
  SITE (1001)..(1001): Xaa can be any amino acid
  SITE (1002)..(1002): Xaa can be any amino acid
  SITE (1004)..(1004): Xaa can be any amino acid except Pro or Gly
  SITE (1005)..(1005): Xaa can be any amino acid except Pro or Gly
  SITE (1006)..(1006): Xaa can be any amino acid except Pro or Gly
  SITE (1008)..(1008): Xaa can be any amino acid
  SITE (1009)..(1009): Xaa can be any amino acid
  SITE (1010)..(1010): Xaa can be any amino acid
  SITE (1012)..(1012): Xaa can be any amino acid except Pro or Gly
  SITE (1013)..(1013): Xaa can be any amino acid except Pro or Gly
  SITE (1014)..(1014): Xaa can be any amino acid except Pro or Gly
  SITE (1016)..(1016): Xaa can be any amino acid
  SITE (1017)..(1017): Xaa can be any amino acid
  SITE (1018)..(1018): Xaa can be any amino acid
  SITE (1020)..(1020): Xaa can be any amino acid except Pro or Gly
  SITE (1021)..(1021): Xaa can be any amino acid except Pro or Gly
  SITE (1022)..(1022): Xaa can be any amino acid except Pro or Gly
  SITE (1024)..(1024): Xaa can be any amino acid
  SITE (1025)..(1025): Xaa can be any amino acid
  SITE (1026)..(1026): Xaa can be any amino acid
  SITE (1028)..(1028): Xaa can be any amino acid except Pro or Gly
  SITE (1029)..(1029): Xaa can be any amino acid except Pro or Gly
  SITE (1030)..(1030): Xaa can be any amino acid except Pro or Gly
  SITE (1032)..(1032): Xaa can be any amino acid
  SITE (1033)..(1033): Xaa can be any amino acid
  SITE (1034)..(1034): Xaa can be any amino acid
  SITE (1036)..(1036): Xaa can be any amino acid except Pro or Gly
  SITE (1037)..(1037): Xaa can be any amino acid except Pro or Gly
  SITE (1038)..(1038): Xaa can be any amino acid except Pro or Gly
  SITE (1040)..(1040): Xaa can be any amino acid
  SITE (1041)..(1041): Xaa can be any amino acid
  SITE (1042)..(1042): Xaa can be any amino acid
  SITE (1044)..(1044): Xaa can be any amino acid except Pro or Gly
  SITE (1045)..(1045): Xaa can be any amino acid except Pro or Gly
  SITE (1046)..(1046): Xaa can be any amino acid except Pro or Gly
  SITE (1048)..(1048): Xaa can be any amino acid
  SITE (1049)..(1049): Xaa can be any amino acid
  SITE (1050)..(1050): Xaa can be any amino acid
  SITE (1052)..(1052): Xaa can be any amino acid except Pro or Gly
  SITE (1053)..(1053): Xaa can be any amino acid except Pro or Gly
  SITE (1054)..(1054): Xaa can be any amino acid except Pro or Gly
  SITE (1056)..(1056): Xaa can be any amino acid
  SITE (1057)..(1057): Xaa can be any amino acid
  SITE (1058)..(1058): Xaa can be any amino acid
  SITE (1060)..(1060): Xaa can be any amino acid except Pro or Gly
  SITE (1061)..(1061): Xaa can be any amino acid except Pro or Gly
  SITE (1062)..(1062): Xaa can be any amino acid except Pro or Gly
  SITE (1064)..(1064): Xaa can be any amino acid
  SITE (1065)..(1065): Xaa can be any amino acid
  SITE (1066)..(1066): Xaa can be any amino acid
  SITE (1068)..(1068): Xaa can be any amino acid except Pro or Gly
  SITE (1069)..(1069): Xaa can be any amino acid except Pro or Gly
  SITE (1070)..(1070): Xaa can be any amino acid except Pro or Gly
  SITE (1072)..(1072): Xaa can be any amino acid
  SITE (1073)..(1073): Xaa can be any amino acid
  SITE (1074)..(1074): Xaa can be any amino acid
  SITE (1076)..(1076): Xaa can be any amino acid except Pro or Gly
  SITE (1077)..(1077): Xaa can be any amino acid except Pro or Gly
  SITE (1078)..(1078): Xaa can be any amino acid except Pro or Gly
  SITE (1080)..(1080): Xaa can be any amino acid
  SITE (1081)..(1081): Xaa can be any amino acid
  SITE (1082)..(1082): Xaa can be any amino acid
  SITE (1084)..(1084): Xaa can be any amino acid except Pro or Gly
  SITE (1085)..(1085): Xaa can be any amino acid except Pro or Gly
  SITE (1086)..(1086): Xaa can be any amino acid except Pro or Gly
  SITE (1088)..(1088): Xaa can be any amino acid
  SITE (1089)..(1089): Xaa can be any amino acid
  SITE (1090)..(1090): Xaa can be any amino acid
  SITE (1092)..(1092): Xaa can be any amino acid except Pro or Gly
  SITE (1093)..(1093): Xaa can be any amino acid except Pro or Gly
  SITE (1094)..(1094): Xaa can be any amino acid except Pro or Gly
  SITE (1096)..(1096): Xaa can be any amino acid
  SITE (1097)..(1097): Xaa can be any amino acid
  SITE (1098)..(1098): Xaa can be any amino acid
  SITE (1100)..(1100): Xaa can be any amino acid except Pro or Gly
  SITE (1101)..(1101): Xaa can be any amino acid except Pro or Gly
  SITE (1102)..(1102): Xaa can be any amino acid except Pro or Gly
  SITE (1104)..(1104): Xaa can be any amino acid
  SITE (1105)..(1105): Xaa can be any amino acid
  SITE (1106)..(1106): Xaa can be any amino acid
  SITE (1108)..(1108): Xaa can be any amino acid except Pro or Gly
  SITE (1109)..(1109): Xaa can be any amino acid except Pro or Gly
  SITE (1110)..(1110): Xaa can be any amino acid except Pro or Gly
  SITE (1112)..(1112): Xaa can be any amino acid
  SITE (1113)..(1113): Xaa can be any amino acid
  SITE (1114)..(1114): Xaa can be any amino acid
  SITE (1116)..(1116): Xaa can be any amino acid except Pro or Gly
  SITE (1117)..(1117): Xaa can be any amino acid except Pro or Gly
  SITE (1118)..(1118): Xaa can be any amino acid except Pro or Gly
  SITE (1120)..(1120): Xaa can be any amino acid
  SITE (1121)..(1121): Xaa can be any amino acid
  SITE (1122)..(1122): Xaa can be any amino acid
  SITE (1124)..(1124): Xaa can be any amino acid except Pro or Gly
  SITE (1125)..(1125): Xaa can be any amino acid except Pro or Gly
  SITE (1126)..(1126): Xaa can be any amino acid except Pro or Gly
  SITE (1128)..(1128): Xaa can be any amino acid
  SITE (1129)..(1129): Xaa can be any amino acid
  SITE (1130)..(1130): Xaa can be any amino acid
  SITE (1132)..(1132): Xaa can be any amino acid except Pro or Gly
  SITE (1133)..(1133): Xaa can be any amino acid except Pro or Gly
  SITE (1134)..(1134): Xaa can be any amino acid except Pro or Gly
  SITE (1136)..(1136): Xaa can be any amino acid
  SITE (1137)..(1137): Xaa can be any amino acid
  SITE (1138)..(1138): Xaa can be any amino acid
  SITE (1140)..(1140): Xaa can be any amino acid except Pro or Gly
  SITE (1141)..(1141): Xaa can be any amino acid except Pro or Gly
  SITE (1142)..(1142): Xaa can be any amino acid except Pro or Gly
  SITE (1144)..(1144): Xaa can be any amino acid
  SITE (1145)..(1145): Xaa can be any amino acid
  SITE (1146)..(1146): Xaa can be any amino acid
  SITE (1148)..(1148): Xaa can be any amino acid except Pro or Gly
  SITE (1149)..(1149): Xaa can be any amino acid except Pro or Gly
  SITE (1150)..(1150): Xaa can be any amino acid except Pro or Gly
  SITE (1152)..(1152): Xaa can be any amino acid
  SITE (1153)..(1153): Xaa can be any amino acid
  SITE (1154)..(1154): Xaa can be any amino acid
  SITE (1156)..(1156): Xaa can be any amino acid except Pro or Gly
  SITE (1157)..(1157): Xaa can be any amino acid except Pro or Gly
  SITE (1158)..(1158): Xaa can be any amino acid except Pro or Gly
  SITE (1160)..(1160): Xaa can be any amino acid
  SITE (1161)..(1161): Xaa can be any amino acid
  SITE (1162)..(1162): Xaa can be any amino acid
  SITE (1164)..(1164): Xaa can be any amino acid except Pro or Gly
  SITE (1165)..(1165): Xaa can be any amino acid except Pro or Gly
  SITE (1166)..(1166): Xaa can be any amino acid except Pro or Gly
  SITE (1168)..(1168): Xaa can be any amino acid
  SITE (1169)..(1169): Xaa can be any amino acid
  SITE (1170)..(1170): Xaa can be any amino acid
  SITE (1172)..(1172): Xaa can be any amino acid except Pro or Gly
  SITE (1173)..(1173): Xaa can be any amino acid except Pro or Gly
  SITE (1174)..(1174): Xaa can be any amino acid except Pro or Gly
  SITE (1176)..(1176): Xaa can be any amino acid
  SITE (1177)..(1177): Xaa can be any amino acid
  SITE (1178)..(1178): Xaa can be any amino acid
  SITE (1180)..(1180): Xaa can be any amino acid except Pro or Gly
  SITE (1181)..(1181): Xaa can be any amino acid except Pro or Gly
  SITE (1182)..(1182): Xaa can be any amino acid except Pro or Gly
  SITE (1184)..(1184): Xaa can be any amino acid
  SITE (1185)..(1185): Xaa can be any amino acid
  SITE (1186)..(1186): Xaa can be any amino acid
  SITE (1188)..(1188): Xaa can be any amino acid except Pro or Gly
  SITE (1189)..(1189): Xaa can be any amino acid except Pro or Gly
  SITE (1190)..(1190): Xaa can be any amino acid except Pro or Gly
  SITE (1192)..(1192): Xaa can be any amino acid
  SITE (1193)..(1193): Xaa can be any amino acid
  SITE (1194)..(1194): Xaa can be any amino acid
  SITE (1196)..(1196): Xaa can be any amino acid except Pro or Gly
  SITE (1197)..(1197): Xaa can be any amino acid except Pro or Gly
  SITE (1198)..(1198): Xaa can be any amino acid except Pro or Gly
  SITE (1200)..(1200): Xaa can be any amino acid
  SITE (1201)..(1201): Xaa can be any amino acid
  SITE (1202)..(1202): Xaa can be any amino acid
  SITE (1204)..(1204): Xaa can be any amino acid except Pro or Gly
  SITE (1205)..(1205): Xaa can be any amino acid except Pro or Gly
  SITE (1206)..(1206): Xaa can be any amino acid except Pro or Gly
  SITE (1208)..(1208): Xaa can be any amino acid
  SITE (1209)..(1209): Xaa can be any amino acid
  SITE (1210)..(1210): Xaa can be any amino acid
  SITE (1212)..(1212): Xaa can be any amino acid except Pro or Gly
  SITE (1213)..(1213): Xaa can be any amino acid except Pro or Gly
  SITE (1214)..(1214): Xaa can be any amino acid except Pro or Gly
  SITE (1216)..(1216): Xaa can be any amino acid
  SITE (1217)..(1217): Xaa can be any amino acid
  SITE (1218)..(1218): Xaa can be any amino acid
  SITE (1220)..(1220): Xaa can be any amino acid except Pro or Gly
  SITE (1221)..(1221): Xaa can be any amino acid except Pro or Gly
  SITE (1222)..(1222): Xaa can be any amino acid except Pro or Gly
  SITE (1224)..(1224): Xaa can be any amino acid
  SITE (1225)..(1225): Xaa can be any amino acid
  SITE (1226)..(1226): Xaa can be any amino acid
  SITE (1228)..(1228): Xaa can be any amino acid except Pro or Gly
  SITE (1229)..(1229): Xaa can be any amino acid except Pro or Gly
  SITE (1230)..(1230): Xaa can be any amino acid except Pro or Gly
  SITE (1232)..(1232): Xaa can be any amino acid
  SITE (1233)..(1233): Xaa can be any amino acid
  SITE (1234)..(1234): Xaa can be any amino acid
  SITE (1236)..(1236): Xaa can be any amino acid except Pro or Gly
  SITE (1237)..(1237): Xaa can be any amino acid except Pro or Gly
  SITE (1238)..(1238): Xaa can be any amino acid except Pro or Gly
  SITE (1240)..(1240): Xaa can be any amino acid
  SITE (1241)..(1241): Xaa can be any amino acid
  SITE (1242)..(1242): Xaa can be any amino acid
  SITE (1244)..(1244): Xaa can be any amino acid except Pro or Gly
  SITE (1245)..(1245): Xaa can be any amino acid except Pro or Gly
  SITE (1246)..(1246): Xaa can be any amino acid except Pro or Gly
  SITE (1248)..(1248): Xaa can be any amino acid
  SITE (1249)..(1249): Xaa can be any amino acid
  SITE (1250)..(1250): Xaa can be any amino acid
  SITE (1252)..(1252): Xaa can be any amino acid except Pro or Gly
  SITE (1253)..(1253): Xaa can be any amino acid except Pro or Gly
  SITE (1254)..(1254): Xaa can be any amino acid except Pro or Gly
  SITE (1256)..(1256): Xaa can be any amino acid
  SITE (1257)..(1257): Xaa can be any amino acid
  SITE (1258)..(1258): Xaa can be any amino acid
  SITE (1260)..(1260): Xaa can be any amino acid except Pro or Gly
  SITE (1261)..(1261): Xaa can be any amino acid except Pro or Gly
  SITE (1262)..(1262): Xaa can be any amino acid except Pro or Gly
  SITE (1264)..(1264): Xaa can be any amino acid
  SITE (1265)..(1265): Xaa can be any amino acid
  SITE (1266)..(1266): Xaa can be any amino acid
  SITE (1268)..(1268): Xaa can be any amino acid except Pro or Gly
  SITE (1269)..(1269): Xaa can be any amino acid except Pro or Gly
  SITE (1270)..(1270): Xaa can be any amino acid except Pro or Gly
  SITE (1272)..(1272): Xaa can be any amino acid
  SITE (1273)..(1273): Xaa can be any amino acid
  SITE (1274)..(1274): Xaa can be any amino acid
  SITE (1276)..(1276): Xaa can be any amino acid except Pro or Gly
  SITE (1277)..(1277): Xaa can be any amino acid except Pro or Gly
  SITE (1278)..(1278): Xaa can be any amino acid except Pro or Gly
  SITE (1280)..(1280): Xaa can be any amino acid
XXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGXXXPXXXGX

SEQ ID NO: 61 - protein, 1280 aa, Artificial Sequence
  elastin-like polypeptide
  SITE (5)..(5): Xaa is Gln or Ser
  SITE (7)..(7): Xaa is Tyr or Val
  SITE (8)..(8): Xaa is Gln or Ser
  SITE (13)..(13): Xaa is Gln or Ser
  SITE (15)..(15): Xaa is Tyr or Val
  SITE (16)..(16): Xaa is Gln or Ser
  SITE (21)..(21): Xaa is Gln or Ser
  SITE (23)..(23): Xaa is Tyr or Val
  SITE (24)..(24): Xaa is Gln or Ser
  SITE (29)..(29): Xaa is Gln or Ser
  SITE (31)..(31): Xaa is Tyr or Val
  SITE (32)..(32): Xaa is Gln or Ser
  SITE (37)..(37): Xaa is Gln or Ser
  SITE (39)..(39): Xaa is Tyr or Val
  SITE (40)..(40): Xaa is Gln or Ser
  SITE (45)..(45): Xaa is Gln or Ser
  SITE (47)..(47): Xaa is Tyr or Val
  SITE (48)..(48): Xaa is Gln or Ser
  SITE (53)..(53): Xaa is Gln or Ser
  SITE (55)..(55): Xaa is Tyr or Val
  SITE (56)..(56): Xaa is Gln or Ser
  SITE (61)..(61): Xaa is Gln or Ser
  SITE (63)..(63): Xaa is Tyr or Val
  SITE (64)..(64): Xaa is Gln or Ser
  SITE (69)..(69): Xaa is Gln or Ser
  SITE (71)..(71): Xaa is Tyr or Val
  SITE (72)..(72): Xaa is Gln or Ser
  SITE (77)..(77): Xaa is Gln or Ser
  SITE (79)..(79): Xaa is Tyr or Val
  SITE (80)..(80): Xaa is Gln or Ser
  SITE (81)..(1280): May be present or absent in groups of the repeat unit Gly Arg Gly Asp Xaa Pro Xaa Xaa
  SITE (85)..(85): Xaa is Gln or Ser
  SITE (87)..(87): Xaa is Tyr or Val
  SITE (88)..(88): Xaa is Gln or Ser
  SITE (93)..(93): Xaa is Gln or Ser
  SITE (95)..(95): Xaa is Tyr or Val
  SITE (96)..(96): Xaa is Gln or Ser
  SITE (101)..(101): Xaa is Gln or Ser
  SITE (103)..(103): Xaa is Tyr or Val
  SITE (104)..(104): Xaa is Gln or Ser
  SITE (109)..(109): Xaa is Gln or Ser
  SITE (111)..(111): Xaa is Tyr or Val
  SITE (112)..(112): Xaa is Gln or Ser
  SITE (117)..(117): Xaa is Gln or Ser
  SITE (119)..(119): Xaa is Tyr or Val
  SITE (120)..(120): Xaa is Gln or Ser
  SITE (125)..(125): Xaa is Gln or Ser
  SITE (127)..(127): Xaa is Tyr or Val
  SITE (128)..(128): Xaa is Gln or Ser
  SITE (133)..(133): Xaa is Gln or Ser
  SITE (135)..(135): Xaa is Tyr or Val
  SITE (136)..(136): Xaa is Gln or Ser
  SITE (141)..(141): Xaa is Gln or Ser
  SITE (143)..(143): Xaa is Tyr or Val
  SITE (144)..(144): Xaa is Gln or Ser
  SITE (149)..(149): Xaa is Gln or Ser
  SITE (151)..(151): Xaa is Tyr or Val
  SITE (152)..(152): Xaa is Gln or Ser
  SITE (157)..(157): Xaa is Gln or Ser
  SITE (159)..(159): Xaa is Tyr or Val
  SITE (160)..(160): Xaa is Gln or Ser
  SITE (165)..(165): Xaa is Gln or Ser
  SITE (167)..(167): Xaa is Tyr or Val
  SITE (168)..(168): Xaa is Gln or Ser
  SITE (173)..(173): Xaa is Gln or Ser
  SITE (175)..(175): Xaa is Tyr or Val
  SITE (176)..(176): Xaa is Gln or Ser
  SITE (181)..(181): Xaa is Gln or Ser
  SITE (183)..(183): Xaa is Tyr or Val
  SITE (184)..(184): Xaa is Gln or Ser
  SITE (189)..(189): Xaa is Gln or Ser
  SITE (191)..(191): Xaa is Tyr or Val
  SITE (192)..(192): Xaa is Gln or Ser
  SITE (197)..(197): Xaa is Gln or Ser
  SITE (199)..(199): Xaa is Tyr or Val
  SITE (200)..(200): Xaa is Gln or Ser
  SITE (205)..(205): Xaa is Gln or Ser
  SITE (207)..(207): Xaa is Tyr or Val
  SITE (208)..(208): Xaa is Gln or Ser
  SITE (213)..(213): Xaa is Gln or Ser
  SITE (215)..(215): Xaa is Tyr or Val
  SITE (216)..(216): Xaa is Gln or Ser
  SITE (221)..(221): Xaa is Gln or Ser
  SITE (223)..(223): Xaa is Tyr or Val
  SITE (224)..(224): Xaa is Gln or Ser
  SITE (229)..(229): Xaa is Gln or Ser
  SITE (231)..(231): Xaa is Tyr or Val
  SITE (232)..(232): Xaa is Gln or Ser
  SITE (237)..(237): Xaa is Gln or Ser
  SITE (239)..(239): Xaa is Tyr or Val
  SITE (240)..(240): Xaa is Gln or Ser
  SITE (245)..(245): Xaa is Gln or Ser
  SITE (247)..(247): Xaa is Tyr or Val
  SITE (248)..(248): Xaa is Gln or Ser
  SITE (253)..(253): Xaa is Gln or Ser
  SITE (255)..(255): Xaa is Tyr or Val
  SITE (256)..(256): Xaa is Gln or Ser
  SITE (261)..(261): Xaa is Gln or Ser
  SITE (263)..(263): Xaa is Tyr or Val
  SITE (264)..(264): Xaa is Gln or Ser
  SITE (269)..(269): Xaa is Gln or Ser
  SITE (271)..(271): Xaa is Tyr or Val
  SITE (272)..(272): Xaa is Gln or Ser
  SITE (277)..(277): Xaa is Gln or Ser
  SITE (279)..(279): Xaa is Tyr or Val
  SITE (280)..(280): Xaa is Gln or Ser
  SITE (285)..(285): Xaa is Gln or Ser
  SITE (287)..(287): Xaa is Tyr or Val
  SITE (288)..(288): Xaa is Gln or Ser
  SITE (293)..(293): Xaa is Gln or Ser
  SITE (295)..(295): Xaa is Tyr or Val
  SITE (296)..(296): Xaa is Gln or Ser
  SITE (301)..(301): Xaa is Gln or Ser
  SITE (303)..(303): Xaa is Tyr or Val
  SITE (304)..(304): Xaa is Gln or Ser
  SITE (309)..(309): Xaa is Gln or Ser
  SITE (311)..(311): Xaa is Tyr or Val
  SITE (312)..(312): Xaa is Gln or Ser
  SITE (317)..(317): Xaa is Gln or Ser
  SITE (319)..(319): Xaa is Tyr or Val
  SITE (320)..(320): Xaa is Gln or Ser
  SITE (325)..(325): Xaa is Gln or Ser
  SITE (327)..(327): Xaa is Tyr or Val
  SITE (328)..(328): Xaa is Gln or Ser
  SITE (333)..(333): Xaa is Gln or Ser
  SITE (335)..(335): Xaa is Tyr or Val
  SITE (336)..(336): Xaa is Gln or Ser
  SITE (341)..(341): Xaa is Gln or Ser
  SITE (343)..(343): Xaa is Tyr or Val
  SITE (344)..(344): Xaa is Gln or Ser
  SITE (349)..(349): Xaa is Gln or Ser
  SITE (351)..(351): Xaa is Tyr or Val
  SITE (352)..(352): Xaa is Gln or Ser
  SITE (357)..(357): Xaa is Gln or Ser
  SITE (359)..(359): Xaa is Tyr or Val
  SITE (360)..(360): Xaa is Gln or Ser
  SITE (365)..(365): Xaa is Gln or Ser
  SITE (367)..(367): Xaa is Tyr or Val
  SITE (368)..(368): Xaa is Gln or Ser
  SITE (373)..(373): Xaa is Gln or Ser
  SITE (375)..(375): Xaa is Tyr or Val
  SITE (376)..(376): Xaa is Gln or Ser
  SITE (381)..(381): Xaa is Gln or Ser
  SITE (383)..(383): Xaa is Tyr or Val
  SITE (384)..(384): Xaa is Gln or Ser
  SITE (389)..(389): Xaa is Gln or Ser
  SITE (391)..(391): Xaa is Tyr or Val
  SITE (392)..(392): Xaa is Gln or Ser
  SITE (397)..(397): Xaa is Gln or Ser
  SITE (399)..(399): Xaa is Tyr or Val
  SITE (400)..(400): Xaa is Gln or Ser
  SITE (405)..(405): Xaa is Gln or Ser
  SITE (407)..(407): Xaa is Tyr or Val
  SITE (408)..(408): Xaa is Gln or Ser
  SITE (413)..(413): Xaa is Gln or Ser
  SITE (415)..(415): Xaa is Tyr or Val
  SITE (416)..(416): Xaa is Gln or Ser
  SITE (421)..(421): Xaa is Gln or Ser
  SITE (423)..(423): Xaa is Tyr or Val
  SITE (424)..(424): Xaa is Gln or Ser
  SITE (429)..(429): Xaa is Gln or Ser
  SITE (431)..(431): Xaa is Tyr or Val
  SITE (432)..(432): Xaa is Gln or Ser
  SITE (437)..(437): Xaa is Gln or Ser
  SITE (439)..(439): Xaa is Tyr or Val
  SITE (440)..(440): Xaa is Gln or Ser
  SITE (445)..(445): Xaa is Gln or Ser
  SITE (447)..(447): Xaa is Tyr or Val
  SITE (448)..(448): Xaa is Gln or Ser
  SITE (453)..(453): Xaa is Gln or Ser
  SITE (455)..(455): Xaa is Tyr or Val
  SITE (456)..(456): Xaa is Gln or Ser
  SITE (461)..(461): Xaa is Gln or Ser
  SITE (463)..(463): Xaa is Tyr or Val
  SITE (464)..(464): Xaa is Gln or Ser
  SITE (469)..(469): Xaa is Gln or Ser
  SITE (471)..(471): Xaa is Tyr or Val
  SITE (472)..(472): Xaa is Gln or Ser
  SITE (477)..(477): Xaa is Gln or Ser
  SITE (479)..(479): Xaa is Tyr or Val
  SITE (480)..(480): Xaa is Gln or Ser
  SITE (485)..(485): Xaa is Gln or Ser
  SITE (487)..(487): Xaa is Tyr or Val
  SITE (488)..(488): Xaa is Gln or Ser
  SITE (493)..(493): Xaa is Gln or Ser
  SITE (495)..(495): Xaa is Tyr or Val
  SITE (496)..(496): Xaa is Gln or Ser
  SITE (501)..(501): Xaa is Gln or Ser
  SITE (503)..(503): Xaa is Tyr or Val
  SITE (504)..(504): Xaa is Gln or Ser
  SITE (509)..(509): Xaa is Gln or Ser
  SITE (511)..(511): Xaa is Tyr or Val
  SITE (512)..(512): Xaa is Gln or Ser
  SITE (517)..(517): Xaa is Gln or Ser
  SITE (519)..(519): Xaa is Tyr or Val
  SITE (520)..(520): Xaa is Gln or Ser
  SITE (525)..(525): Xaa is Gln or Ser
  SITE (527)..(527): Xaa is Tyr or Val
  SITE (528)..(528): Xaa is Gln or Ser
  SITE (533)..(533): Xaa is Gln or Ser
  SITE (535)..(535): Xaa is Tyr or Val
  SITE (536)..(536): Xaa is Gln or Ser
  SITE (541)..(541): Xaa is Gln or Ser
  SITE (543)..(543): Xaa is Tyr or Val
  SITE (544)..(544): Xaa is Gln or Ser
  SITE (549)..(549): Xaa is Gln or Ser
  SITE (551)..(551): Xaa is Tyr or Val
  SITE (552)..(552): Xaa is Gln or Ser
  SITE (557)..(557): Xaa is Gln or Ser
  SITE (559)..(559): Xaa is Tyr or Val
  SITE (560)..(560): Xaa is Gln or Ser
  SITE (565)..(565): Xaa is Gln or Ser
  SITE (567)..(567): Xaa is Tyr or Val
  SITE (568)..(568): Xaa is Gln or Ser
  SITE (573)..(573): Xaa is Gln or Ser
  SITE (575)..(575): Xaa is Tyr or Val
  SITE (576)..(576): Xaa is Gln or Ser
  SITE (581)..(581): Xaa is Gln or Ser
  SITE (583)..(583): Xaa is Tyr or Val
  SITE (584)..(584): Xaa is Gln or Ser
  SITE (589)..(589): Xaa is Gln or Ser
  SITE (591)..(591): Xaa is Tyr or Val
  SITE (592)..(592): Xaa is Gln or Ser
  SITE (597)..(597): Xaa is Gln or Ser
  SITE (599)..(599): Xaa is Tyr or Val
  SITE (600)..(600): Xaa is Gln or Ser
  SITE (605)..(605): Xaa is Gln or Ser
  SITE (607)..(607): Xaa is Tyr or Val
  SITE (608)..(608): Xaa is Gln or Ser
  SITE (613)..(613): Xaa is Gln or Ser
  SITE (615)..(615): Xaa is Tyr or Val
  SITE (616)..(616): Xaa is Gln or Ser
  SITE (621)..(621): Xaa is Gln or Ser
  SITE (623)..(623): Xaa is Tyr or Val
  SITE (624)..(624): Xaa is Gln or Ser
  SITE (629)..(629): Xaa is Gln or Ser
  SITE (631)..(631): Xaa is Tyr or Val
  SITE (632)..(632): Xaa is Gln or Ser
  SITE (637)..(637): Xaa is Gln or Ser
  SITE (639)..(639): Xaa is Tyr or Val
  SITE (640)..(640): Xaa is Gln or Ser
  SITE (645)..(645): Xaa is Gln or Ser
  SITE (647)..(647): Xaa is Tyr or Val
  SITE (648)..(648): Xaa is Gln or Ser
  SITE (653)..(653): Xaa is Gln or Ser
  SITE (655)..(655): Xaa is Tyr or Val
  SITE (656)..(656): Xaa is Gln or Ser
  SITE (661)..(661): Xaa is Gln or Ser
  SITE (663)..(663): Xaa is Tyr or Val
  SITE (664)..(664): Xaa is Gln or Ser
  SITE (669)..(669): Xaa is Gln or Ser
  SITE (671)..(671): Xaa is Tyr or Val
  SITE (672)..(672): Xaa is Gln or Ser
  SITE (677)..(677): Xaa is Gln or Ser
  SITE (679)..(679): Xaa is Tyr or Val
  SITE (680)..(680): Xaa is Gln or Ser
  SITE (685)..(685): Xaa is Gln or Ser
  SITE (687)..(687): Xaa is Tyr or Val
  SITE (688)..(688): Xaa is Gln or Ser
  SITE (693)..(693): Xaa is Gln or Ser
  SITE (695)..(695): Xaa is Tyr or Val
  SITE (696)..(696): Xaa is Gln or Ser
  SITE (701)..(701): Xaa is Gln or Ser
  SITE (703)..(703): Xaa is Tyr or Val
  SITE (704)..(704): Xaa is Gln or Ser
  SITE (709)..(709): Xaa is Gln or Ser
  SITE (711)..(711): Xaa is Tyr or Val
  SITE (712)..(712): Xaa is Gln or Ser
  SITE (717)..(717): Xaa is Gln or Ser
  SITE (719)..(719): Xaa is Tyr or Val
  SITE (720)..(720): Xaa is Gln or Ser
  SITE (725)..(725): Xaa is Gln or Ser
  SITE (727)..(727): Xaa is Tyr or Val
  SITE (728)..(728): Xaa is Gln or Ser
  SITE (733)..(733): Xaa is Gln or Ser
  SITE (735)..(735): Xaa is Tyr or Val
  SITE (736)..(736): Xaa is Gln or Ser
  SITE (741)..(741): Xaa is Gln or Ser
  SITE (743)..(743): Xaa is Tyr or Val
  SITE (744)..(744): Xaa is Gln or Ser
  SITE (749)..(749): Xaa is Gln or Ser
  SITE (751)..(751): Xaa is Tyr or Val
  SITE (752)..(752): Xaa is Gln or Ser
  SITE (757)..(757): Xaa is Gln or Ser
  SITE (759)..(759): Xaa is Tyr or Val
  SITE (760)..(760): Xaa is Gln or Ser
  SITE (765)..(765): Xaa is Gln or Ser
  SITE (767)..(767): Xaa is Tyr or Val
  SITE (768)..(768): Xaa is Gln or Ser
  SITE (773)..(773): Xaa is Gln or Ser
  SITE (775)..(775): Xaa is Tyr or Val
  SITE (776)..(776): Xaa is Gln or Ser
  SITE (781)..(781): Xaa is Gln or Ser
  SITE (783)..(783): Xaa is Tyr or Val
  SITE (784)..(784): Xaa is Gln or Ser
  SITE (789)..(789): Xaa is Gln or Ser
  SITE (791)..(791): Xaa is Tyr or Val
  SITE (792)..(792): Xaa is Gln or Ser
  SITE (797)..(797): Xaa is Gln or Ser
  SITE (799)..(799): Xaa is Tyr or Val
  SITE (800)..(800): Xaa is Gln or Ser
  SITE (805)..(805): Xaa is Gln or Ser
  SITE (807)..(807): Xaa is Tyr or Val
  SITE (808)..(808): Xaa is Gln or Ser
  SITE (813)..(813): Xaa is Gln or Ser
  SITE (815)..(815): Xaa is Tyr or Val
  SITE (816)..(816): Xaa is Gln or Ser
  SITE (821)..(821): Xaa is Gln or Ser
  SITE (823)..(823): Xaa is Tyr or Val
  SITE (824)..(824): Xaa is Gln or Ser
  SITE (829)..(829): Xaa is Gln or Ser
  SITE (831)..(831): Xaa is Tyr or Val
  SITE (832)..(832): Xaa is Gln or Ser
  SITE (837)..(837): Xaa is Gln or Ser
  SITE (839)..(839): Xaa is Tyr or Val
  SITE (840)..(840): Xaa is Gln or Ser
  SITE (845)..(845): Xaa is Gln or Ser
  SITE (847)..(847): Xaa is Tyr or Val
  SITE (848)..(848): Xaa is Gln or Ser
  SITE (853)..(853): Xaa is Gln or Ser
  SITE (855)..(855): Xaa is Tyr or Val
  SITE (856)..(856): Xaa is Gln or Ser
  SITE (861)..(861): Xaa is Gln or Ser
  SITE (863)..(863): Xaa is Tyr or Val
  SITE (864)..(864): Xaa is Gln or Ser
  SITE (869)..(869): Xaa is Gln or Ser
  SITE (871)..(871): Xaa is Tyr or Val
  SITE (872)..(872): Xaa is Gln or Ser
  SITE (877)..(877): Xaa is Gln or Ser
  SITE (879)..(879): Xaa is Tyr or Val
  SITE (880)..(880): Xaa is Gln or Ser
  SITE (885)..(885): Xaa is Gln or Ser
  SITE (887)..(887): Xaa is Tyr or Val
  SITE (888)..(888): Xaa is Gln or Ser
  SITE (893)..(893): Xaa is Gln or Ser
  SITE (895)..(895): Xaa is Tyr or Val
  SITE (896)..(896): Xaa is Gln or Ser
  SITE (901)..(901): Xaa is Gln or Ser
  SITE (903)..(903): Xaa is Tyr or Val
  SITE (904)..(904): Xaa is Gln or Ser
  SITE (909)..(909): Xaa is Gln or Ser
  SITE (911)..(911): Xaa is Tyr or Val
  SITE (912)..(912): Xaa is Gln or Ser
  SITE (917)..(917): Xaa is Gln or Ser
  SITE (919)..(919): Xaa is Tyr or Val
  SITE (920)..(920): Xaa is Gln or Ser
  SITE (925)..(925): Xaa is Gln or Ser
  SITE (927)..(927): Xaa is Tyr or Val
  SITE (928)..(928): Xaa is Gln or Ser
  SITE (933)..(933): Xaa is Gln or Ser
  SITE (935)..(935): Xaa is Tyr or Val
  SITE (936)..(936): Xaa is Gln or Ser
  SITE (941)..(941): Xaa is Gln or Ser
  SITE (943)..(943): Xaa is Tyr or Val
  SITE (944)..(944): Xaa is Gln or Ser
  SITE (949)..(949): Xaa is Gln or Ser
  SITE (951)..(951): Xaa is Tyr or Val
  SITE (952)..(952): Xaa is Gln or Ser
  SITE (957)..(957): Xaa is Gln or Ser
  SITE (959)..(959): Xaa is Tyr or Val
  SITE (960)..(960): Xaa is Gln or Ser
  SITE (965)..(965): Xaa is Gln or Ser
  SITE (967)..(967): Xaa is Tyr or Val
  SITE (968)..(968): Xaa is Gln or Ser
  SITE (973)..(973): Xaa is Gln or Ser
  SITE (975)..(975): Xaa is Tyr or Val
  SITE (976)..(976): Xaa is Gln or Ser
  SITE (981)..(981): Xaa is Gln or Ser
  SITE (983)..(983): Xaa is Tyr or Val
  SITE (984)..(984): Xaa is Gln or Ser
  SITE (989)..(989): Xaa is Gln or Ser
  SITE (991)..(991): Xaa is Tyr or Val
  SITE (992)..(992): Xaa is Gln or Ser
  SITE (997)..(997): Xaa is Gln or Ser
  SITE (999)..(999): Xaa is Tyr or Val
  SITE (1000)..(1000): Xaa is Gln or Ser
  SITE (1005)..(1005): Xaa is Gln or Ser
  SITE (1007)..(1007): Xaa is Tyr or Val
  SITE (1008)..(1008): Xaa is Gln or Ser
  SITE (1013)..(1013): Xaa is Gln or Ser
  SITE (1015)..(1015): Xaa is Tyr or Val
  SITE (1016)..(1016): Xaa is Gln or Ser
  SITE (1021)..(1021): Xaa is Gln or Ser
  SITE (1023)..(1023): Xaa is Tyr or Val
  SITE (1024)..(1024): Xaa is Gln or Ser
  SITE (1029)..(1029): Xaa is Gln or Ser
  SITE (1031)..(1031): Xaa is Tyr or Val
  SITE (1032)..(1032): Xaa is Gln or Ser
  SITE (1037)..(1037): Xaa is Gln or Ser
  SITE (1039)..(1039): Xaa is Tyr or Val
  SITE (1040)..(1040): Xaa is Gln or Ser
  SITE (1045)..(1045): Xaa is Gln or Ser
  SITE (1047)..(1047): Xaa is Tyr or Val
  SITE (1048)..(1048): Xaa is Gln or Ser
  SITE (1053)..(1053): Xaa is Gln or Ser
  SITE (1055)..(1055): Xaa is Tyr or Val
  SITE (1056)..(1056): Xaa is Gln or Ser
  SITE (1061)..(1061): Xaa is Gln or Ser
  SITE (1063)..(1063): Xaa is Tyr or Val
  SITE (1064)..(1064): Xaa is Gln or Ser
  SITE (1069)..(1069): Xaa is Gln or Ser
  SITE (1071)..(1071): Xaa is Tyr or Val
  SITE (1072)..(1072): Xaa is Gln or Ser
  SITE (1077)..(1077): Xaa is Gln or Ser
  SITE (1079)..(1079): Xaa is Tyr or Val
  SITE (1080)..(1080): Xaa is Gln or Ser
  SITE (1085)..(1085): Xaa is Gln or Ser
  SITE (1087)..(1087): Xaa is Tyr or Val
  SITE (1088)..(1088): Xaa is Gln or Ser
  SITE (1093)..(1093): Xaa is Gln or Ser
  SITE (1095)..(1095): Xaa is Tyr or Val
  SITE (1096)..(1096): Xaa is Gln or Ser
  SITE (1101)..(1101): Xaa is Gln or Ser
  SITE (1103)..(1103): Xaa is Tyr or Val
  SITE (1104)..(1104): Xaa is Gln or Ser
  SITE (1109)..(1109): Xaa is Gln or Ser
  SITE (1111)..(1111): Xaa is Tyr or Val
  SITE (1112)..(1112): Xaa is Gln or Ser
  SITE (1117)..(1117): Xaa is Gln or Ser
  SITE (1119)..(1119): Xaa is Tyr or Val
  SITE (1120)..(1120): Xaa is Gln or Ser
  SITE (1125)..(1125): Xaa is Gln or Ser
  SITE (1127)..(1127): Xaa is Tyr or Val
  SITE (1128)..(1128): Xaa is Gln or Ser
  SITE (1133)..(1133): Xaa is Gln or Ser
  SITE (1135)..(1135): Xaa is Tyr or Val
  SITE (1136)..(1136): Xaa is Gln or Ser
  SITE (1141)..(1141): Xaa is Gln or Ser
  SITE (1143)..(1143): Xaa is Tyr or Val
  SITE (1144)..(1144): Xaa is Gln or Ser
  SITE (1149)..(1149): Xaa is Gln or Ser
  SITE (1151)..(1151): Xaa is Tyr or Val
  SITE (1152)..(1152): Xaa is Gln or Ser
  SITE (1157)..(1157): Xaa is Gln or Ser
  SITE (1159)..(1159): Xaa is Tyr or Val
  SITE (1160)..(1160): Xaa is Gln or Ser
  SITE (1165)..(1165): Xaa is Gln or Ser
  SITE (1167)..(1167): Xaa is Tyr or Val
  SITE (1168)..(1168): Xaa is Gln or Ser
  SITE (1173)..(1173): Xaa is Gln or Ser
  SITE (1175)..(1175): Xaa is Tyr or Val
  SITE (1176)..(1176): Xaa is Gln or Ser
  SITE (1181)..(1181): Xaa is Gln or Ser
  SITE (1183)..(1183): Xaa is Tyr or Val
  SITE (1184)..(1184): Xaa is Gln or Ser
  SITE (1189)..(1189): Xaa is Gln or Ser
  SITE (1191)..(1191): Xaa is Tyr or Val
  SITE (1192)..(1192): Xaa is Gln or Ser
  SITE (1197)..(1197): Xaa is Gln or Ser
  SITE (1199)..(1199): Xaa is Tyr or Val
  SITE (1200)..(1200): Xaa is Gln or Ser
  SITE (1205)..(1205): Xaa is Gln or Ser
  SITE (1207)..(1207): Xaa is Tyr or Val
  SITE (1208)..(1208): Xaa is Gln or Ser
  SITE (1213)..(1213): Xaa is Gln or Ser
  SITE (1215)..(1215): Xaa is Tyr or Val
  SITE (1216)..(1216): Xaa is Gln or Ser
  SITE (1221)..(1221): Xaa is Gln or Ser
  SITE (1223)..(1223): Xaa is Tyr or Val
  SITE (1224)..(1224): Xaa is Gln or Ser
  SITE (1229)..(1229): Xaa is Gln or Ser
  SITE (1231)..(1231): Xaa is Tyr or Val
  SITE (1232)..(1232): Xaa is Gln or Ser
  SITE (1237)..(1237): Xaa is Gln or Ser
  SITE (1239)..(1239): Xaa is Tyr or Val
  SITE (1240)..(1240): Xaa is Gln or Ser
  SITE (1245)..(1245): Xaa is Gln or Ser
  SITE (1247)..(1247): Xaa is Tyr or Val
  SITE (1248)..(1248): Xaa is Gln or Ser
  SITE (1253)..(1253): Xaa is Gln or Ser
  SITE (1255)..(1255): Xaa is Tyr or Val
  SITE (1256)..(1256): Xaa is Gln or Ser
  SITE (1261)..(1261): Xaa is Gln or Ser
  SITE (1263)..(1263): Xaa is Tyr or Val
  SITE (1264)..(1264): Xaa is Gln or Ser
  SITE (1269)..(1269): Xaa is Gln or Ser
  SITE (1271)..(1271): Xaa is Tyr or Val
  SITE (1272)..(1272): Xaa is Gln or Ser
  SITE (1277)..(1277): Xaa is Gln or Ser
  SITE (1279)..(1279): Xaa is Tyr or Val
  SITE (1280)..(1280): Xaa is Gln or Ser
GRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXXGRGDXPXX

SEQ ID NO: 62 - protein, 365 aa, Homo Sapiens
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 63 - protein, 219 aa, Homo Sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAG

SEQ ID NO: 64 - protein, 122 aa, Homo Sapiens
MITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPS

SEQ ID NO: 65 - protein, 116 aa, Homo Sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIH

SEQ ID NO: 66 - protein, 89 aa, Homo Sapiens
MPSGARCYVDGSEEIGSDFKIKCEPKEGSLPLQYEWQKLSDSQKMPTSWLAEMTSSVISVKNASSEYSGTYSCTVRNRVGSDQCLLRLN

SEQ ID NO: 67 - protein, 219 aa, Homo Sapiens
MLSITTPEEMIEKAKGETAYLPCKFTLSPEDQGPLDIEWLISPADNQKVDQVGRCATSKEPYVHCQKLHRQRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAG

SEQ ID NO: 68 - protein, 182 aa, Homo Sapiens
MLSITTPEEMIEKAKGETAYLPCKFTLSPEDQGPLDIEWLISPADNQKVDQVGRCATSKEPYVHCQKLHRQRVHFTSNDLKSGDASINVTNLQLSDIGTYQCKVKKAPGVANKKIHLVVLGKMCHLQRAVRPLPEATSAVIIHPWGPCLLPTWKDIPRLSITKYQVKTLNALLRVRLSHLLR

SEQ ID NO: 69 - protein, 235 aa, Homo Sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEGKMCHLQRAVRPLPEATSAVIIHPWGPCLLPTWKDIPRLSITKYQVKTLNALLRVRLSHLLR

SEQ ID NO: 70 - protein, 178 aa, Homo Sapiens
MLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAASNKAG

SEQ ID NO: 71 - protein, 185 aa, Artificial Sequence
  AdPep
  SITE (25)..(47): May be present or absent
  SITE (48)..(70): May be present or absent
  SITE (71)..(93): May be present or absent
  SITE (94)..(116): May be present or absent
  SITE (117)..(139): May be present or absent
  SITE (140)..(162): May be present or absent
  SITE (163)..(185): May be present or absent
MRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGG

SEQ ID NO: 72 - protein, 184 aa, Artificial Sequence
  AdPep
  SITE (24)..(46): May be present or absent
  SITE (47)..(69): May be present or absent
  SITE (70)..(92): May be present or absent
  SITE (93)..(115): May be present or absent
  SITE (116)..(138): May be present or absent
  SITE (139)..(161): May be present or absent
  SITE (162)..(184): May be present or absent
RAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGGRAIVFRVQWLRRYFVNGSRSGGG

SEQ ID NO: 73 - protein, 860 aa, Homo Sapiens [sequence omitted]

SEQ ID NO: 74 - protein, 768 aa, Homo Sapiens
MAVGDRCERNEFQCQDGKCISYKWVCDGSAECQDGSDESQETCLSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACKAVGSIAYLFFTNRHEVRKMTLDRSEYTSLIPNLRNVVALDTEVASNRIYWSDLSQRMICSTQLDRAHGVSSYDTVISRDIQAPDGLAVDWIHSNIYWTDSVLGTVSVADTKGVKRKTLFRENGSKPRAIVVDPVHGFMYWTDWGTPAKIKKGGLNGVDIYSLVTENIQWPNGITLDLLSGRLYWVDSKLHSISSIDVNGGNRKTILEDEKRLAHPFSLAVFEDKVFWTDIINEAIFSANRLTGSDVNLLAENLLSPEDMVLFHNLTQPRGVNWCERTTLSNGGCQYLCLPAPQINPHSPKFTCACPDGMLLARDMRSCLTEAEAAVATQETSTVRLKVSSTAVRTQHTTTRPVPDTSRLPGATPGLTTVEIVTMSHQALGDVAGRGNEKKPSSVR

SEQ ID NO: 75 - protein, 40 aa, Homo Sapiens
MSVTCKSGDFSCGGRVNRCIPQFWRCDGQVDCDNGSDEQG

SEQ ID NO: 76 - protein, 38 aa, Homo Sapiens
MTCSQDEFRCHDGKCISRQFVCDSDRDCLDGSDEASCP

SEQ ID NO: 77 - protein, 330 aa, Homo Sapiens
MSVTCKSGDFSCGGRVNRCIPQFWRCDGQVDCDNGSDEQGCPPKTCSQDEFRCHDGKCISRQFVCDSDRDCLDGSDEASCPVLTCGPASFQCNSSTCIPQLWACDNDPDCEDGSDEWPQRCRGLYVFQGDSSPCSAFEFHCLSGECIHSSWRCDGGPDCKDKSDEENCAVATCRPDEFQCSDGNCIHGSRQCDREYDCKDMSDEVGCVNVTLCEGPNKFKCHSGECITLDKVCNMARDCRDWSDEPIKECGTNECLDNNGGCSHVCNDLKIGYECLCPDGFQLVAQRRCEDIDECQDPDTCSQLCVNLEGGYKCQCEEGFQLDPHTKACK

SEQ ID NO: 78 - protein, 458 aa, Homo Sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 79 - protein, 372 aa, Homo Sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 80 - protein, 179 aa, Homo Sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLA

SEQ ID NO: 81 - protein, 101 aa, Homo Sapiens
MKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGL

SEQ ID NO: 82 - protein, 392 aa, Homo Sapiens [sequence omitted]

SEQ ID NO: 83 - protein, 310 aa, Homo Sapiens
MCEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLD

SEQ ID NO: 84 - protein, 359 aa, Homo Sapiens
MCEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVLPPSSTKPPALSHSVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 85 - protein, 63 aa, Homo Sapiens
MCEEPPTFEAMELIGKPKPYYEIGERVDYKCKKGYFYIPPLATHTICDRNHTWLPVSDDACYR

SEQ ID NO: 86 - protein, 64 aa, Homo Sapiens
METCPYIRDPLNGQAVPANGTYEFGYQMHFICNEGYYLIGEEILYCELKGSVAIWSGKPPICEK

SEQ ID NO: 87 - protein, 67 aa, Homo Sapiens
MVLCTPPPKIKNGKHTFSEVEVFEYLDAVTYSCDPAPGPDPFSLIGESTIYCGDNSVWSRAAPECKV

SEQ ID NO: 88 - protein, 61 aa, Homo Sapiens
MVKCRFPVVENGKQISGFGKKFYYKATVMFECDKGFYLDGSDTIVCDSNSTWDPPVPKCLK

SEQ ID NO: 89 - protein, 26 aa, Homo Sapiens
MSTSSTTKSPASSASGPRPTYKPPVS

SEQ ID NO: 90 - protein, 335 aa, Homo Sapiens
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 91 - protein, 218 aa, Homo Sapiens
MASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKP

SEQ ID NO: 92 - protein, 213 aa, Homo Sapiens
ASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPS

SEQ ID NO: 93 - protein, 510 aa, Homo Sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 94 - protein, 319 aa, Homo Sapiens
MGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSAS

SEQ ID NO: 95 - protein, 113 aa, Homo Sapiens
GELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLR

SEQ ID NO: 96 - protein, 91 aa, Homo Sapiens
MPPLPSLNPGPALEEGQGLTLAASCTAEGSPAPSVTWDTEVKGTTSSRSFKHSRSAAVTSEFHLVPSRSMNGQPLTCVVSHPGLLQDQRIT

SEQ ID NO: 97 - protein, 85 aa, Homo Sapiens
MASVRGLEDQNLWHIGREGAMLKCLSEGQPPPSYNWTRLDGPLPSGVRVDGDTLGFPPLTTEHSGIYVCHVSNEFSSRDSQVTVD

SEQ ID NO: 98 - protein, 288 aa, Homo Sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 99 - protein, 209 aa, Homo Sapiens
MVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 100 - protein, 201 aa, Homo Sapiens
MVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTT

SEQ ID NO: 101 - protein, 329 aa, Homo Sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 102 - protein, 225 aa, Homo Sapiens
MAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 103 - protein, 154 aa, Homo Sapiens
MYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSI

SEQ ID NO: 104 - protein, 116 aa, Homo Sapiens
MLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 105 - protein, 541 aa, Homo Sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 106 - protein, 14 aa, Homo Sapiens
MGPERLSAFVFPGE

SEQ ID NO: 107 - protein, 72 aa, Homo Sapiens
MQPGAASAAINASVGAAGSAENAPSKEVLDSFLDLARNIFPSNLVSAAFRSYSTTYEERNITGTRVKVPVGQ

SEQ ID NO: 108 - protein, 22 aa, Homo Sapiens
MAGKIVEMEDVGLLFARLGKYI

SEQ ID NO: 109 - protein, 14 aa, Homo Sapiens
MIAQLSQQSLDFVK

SEQ ID NO: 110 - protein, 14 aa, Homo Sapiens
MLPVDHISLILAVD

SEQ ID NO: 111 - protein, 532 aa, Homo Sapiens
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 112 - protein, 78 aa, Homo Sapiens
MKPGSGAQTLQSSDLGLEDSGPPPVPKETVDSFLDLARNLFPSNLVVAAFRTYATDYKVVTQNSSSGNVTHEKIPIGT

SEQ ID NO: 113 - protein, 46 aa, Homo Sapiens
MNILGLVLFALVLGVALKKLGSEGEDLIRFFNSLNEATMVLVSWIM

SEQ ID NO: 114 - protein, 333 aa, Homo Sapiens
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 115 - protein, 203 aa, Homo Sapiens
MIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFA

SEQ ID NO: 116 - protein, 679 aa, Homo Sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 117 - protein, 28 aa, Homo Sapiens
MGNDVSNAIGPLVALYLVYDTGDVSSKV

SEQ ID NO: 118 - protein, 10 aa, Homo Sapiens
MIFRYVILRM

SEQ ID NO: 119 - protein, 652 aa, Homo Sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 120 - protein, 28 aa, Homo Sapiens
MGNDVSNAIGPLVALWLIYKQGGVTQEA

SEQ ID NO: 121 - protein, 805 aa, Homo Sapiens [sequence omitted]

SEQ ID NO: 122 - protein, 724 aa, Homo Sapiens
MQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVS

SEQ ID NO: 123 - protein, 598 aa, Homo Sapiens
MSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYAD

SEQ ID NO: 124 - protein, 102 aa, Homo Sapiens
MSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTI

SEQ ID NO: 125 - protein, 48 aa, Artificial Sequence
  Albumin-binding polypeptide
MLAEAKVLANRELDKYGVSDFYKRLINKAKTVEGVEALKLHLLAALPG

SEQ ID NO: 126 - protein, 253 aa, Staphylococcus aureus
MAAQHDEAQQNAFYQVLNMPNLNADQRNGFIQSLKDDPSQSANVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDGNKPGKEDGN

SEQ ID NO: 127 - protein, 59 aa, Staphylococcus aureus
MADNKFNKEQQNAFYEILHLPNLNEEQRNGFIQSLKDDPSQSANLLAEAKKLNDAQAPK

SEQ ID NO: 128 - protein, 59 aa, Staphylococcus aureus
MADNKFNKEQQNAFYEILHLPNLTEEQRNGFIQSLKDDPSVSKEILAEAKKLNDAQAPK

SEQ ID NO: 129 - protein, 992 aa, Finegoldia magna
MKINKKLLMAALAGAIVVGGGANAYAAEEDNTDNNLSMDEISDAYFDYHGDVSDSVDPVEEEIDEALAKALAEAKETAKKHIDSLNHLSETAKKLAKNDIDSATTINAINDIVARADVMERKTAEKEEAEKLAAAKETAKKHIDELKHLADKTKELAKRDIDSATTINAINDIVARADVMERKTAEKEEAEKLAAAKETAKKHIDELKHLADKTKELAKRDIDSATTIDAINDIVARADVMERKLSEKETPEPEEEVTIKANLIFADGSTQNAEFKGTFAKAVSDAYAYADALKKDNGEYTVDVADKGLTLNIKFAGKKEKPEEPKEEVTIKVNLIFADGKTQTAEFKGTFEEATAKAYAYADLLAKENGEYTADLEDGGNTINIKFAGKETPETPEEPKEEVTIKVNLIFADGKIQTAEFKGTFEEATAKAYAYANLLAKENGEYTADLEDGGNTINIKFAGKETPETPEEPKEEVTIKVNLIFADGKTQTAEFKGTFEEATAEAYRYADLLAKVNGEYTADLEDGGYTINIKFAGKEQPGENPGITIDEWLLKNAKEEAIKELKEAGITSDLYFSLINKAKTVEGVEALKNEILKAHAGEETPELKDGYATYEEAEAAAKEALKNDDVNNAYEIVQGADGRYYYVLKIEVADEEEPGEDTPEVQEGYATYEEAEAAAKEALKEDKVNNAYEVVQGADGRYYYVLKIEDKEDEQPGEEPGENPGITIDEWLLKNAKEDAIKELKEAGISSDIYFDAINKAKTVEGVEALKNEILKAHAEKPGENPGITIDEWLLKNAKEAAIKELKEAGITAEYLFNLINKAKTVEGVESLKNEILKAHAEKPGENPGITIDEWLLKNAKEDAIKELKEAGITSDIYFDAINKAKTIEGVEALKNEILKAHKKDEEPGKKPGEDKKPEDKKPGEDKKPEDKKPGEDKKPEDKKPGKTDKDSPNKKKKAKLPKAGSEAEILTLAAAALSTAAGAYVSLKKRK

SEQ ID NO: 130 - protein, 75 aa, Finegoldia magna
MKEEVTIKVNLIFADGKTQTAEFKGTFEEATAKAYAYADLLAKENGEYTADLEDGGNTINIKFAGKETPETPEEP

SEQ ID NO: 131 - protein, 593 aa, Unknown
  Streptococcus sp. group G
MEKEKKVKYFLRKSAFGLASVSAAFLVGSTVFAVDSPIEDTPIIRNGGELTNLLGNSETTLALRNEESATADLTAAAVADTVAAAAAENAGAAAWEAAAAADALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATAEKVFKQYANDNGVDGEWTYDDATKTFTVTEKPEVIDASELTPAVTTYKLVINGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKEDAKKAETLPTTGEGSNPFFTAAALAVMAGAGALAVASKRKED

SEQ ID NO: 132 - protein, 530 aa, Unknown
  Streptococcus sp. group G
MVDSPIEDTPIIRNGGELTNLLGNSETTLALRNEESATADLTAAAVADTVAAAAAENAGAAAWEAAAAADALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALPKTDTYKLILNGKTLKGETTTEAVDAATAEKVFKQYANDNGVDGEWTYDDATKTFTVTEKPEVIDASELTPAVTTYKLVINGKTLKGETTTEAVDAATAEKVFKQYANDNGVDGEWTYDDATKTFTVTEKPEVIDASELTPAVTTYKLVINGKTLKGETTTKAVDAETAEKAFKQYANDNGVDGVWTYDDATKTFTVTEMVTEVPGDAPTEPEKPEASIPLVPLTPATPIAKDDAKKDDTKKEDAKKPEAKKEDAKKAETLPTT

SEQ ID NO: 133 - protein, 72 aa, Unknown
  Streptococcus sp. group G
TYKLILNGKTLKGETTTEAVDAATAEKVFKQYANDNGVDGEWTYDDATKTFTVTEKPEVIDASELTPAVTTY

SEQ ID NO: 134 - protein, 494 aa, Homo Sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 135 - protein, 71 aa, Homo Sapiens
MSTRYKTELCRPFEESGTCKYGEKCQFAHGFHELRSLTRHPKYKTELCRTFHTIGFCPYGPRCHFIHNADE

SEQ ID NO: 136 - protein, 43 aa, Homo Sapiens
MYGEKCQFAHGFHELRSLTRHPKYKTELCRTFHTIGFCPYGPR

SEQ ID NO: 137 - protein, 217 aa, Homo Sapiens [sequence omitted]

SEQ ID NO: 138 - protein, 183 aa, Homo Sapiens
MKHPLQNRWALWFFKNDKSKTWQANLRLISKFDTVEDFWALYNHIQLSSNLMPGCDYSLFKDGIEPMWEDEKNKRGGRWLITLNKQQRRSDLDRFWLETLLCLIGESFDDYSDDVCGAVVNVRAKGDKIAIWTTECENREAVTHIGRVYKERLGLPPKIVIGYQSHADTATKSGSTTKNRFVV

SEQ ID NO: 139 - protein, 636 aa, Homo Sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 140 - protein, 174 aa, Homo Sapiens
MSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKER

SEQ ID NO: 141 - protein, 80 aa, Homo Sapiens
MASLYVGDLHPDVTEAMLYEKFSPAGPILSIRVCRDMITRRSLGYAYVNFQQPADAERALDTMNFDVIKGKPVRIMWSQR

SEQ ID NO: 142 - protein, 78 aa, Homo Sapiens
MGNIFIKNLDKSIDNKALYDTFSAFGNILSCKVVCDENGSKGYGFVHFETQEAAERAIEKMNGMLLNDRKVFVGRFKS

SEQ ID NO: 143 - protein, 79 aa, Homo Sapiens
MTNVYIKNFGEDMDDERLKDLFGKFGPALSVKVMTDESGKSKGFGFVSFERHEDAQKAVDEMNGKELNGKQIYVGRAQK

SEQ ID NO: 144 - protein, 78 aa, Homo Sapiens
MVNLYVKNLDDGIDDERLRKEFSPFGTITSAKVMMEGGRSKGFGFVCFSSPEEATKAVTEMNGRIVATKPLYVALAQR

SEQ ID NO: 145 - protein, 429 aa, Homo Sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 146 - protein, 64 aa, Homo Sapiens
MPGREGHLEQRILQVLTEAGSPVKLAQLVKECQAPKRELNQVLYRMKKELKVSLTSPATWCLGG

SEQ ID NO: 147 - protein, 65 aa, Homo Sapiens
MPQFSQQREEDIYRFLKDNGPQRALVIAQALGMRTAKDVNRDLYRMKSRHLLDMDEQSKAWTIYR

SEQ ID NO: 148 - protein, 991 aa, Capsella rubella
MHRGNEDLSFGDDYEKEIGLLLGEQQRRQEEADEIEKELNLYRSGSAPPTVDGSVNAAGGLFNGGGRGPFMEFGGGNKGNGFGGDDDELRKDPAYLSYYYANMKLNPRLPPPLMSREDLRVAQRLKGSSNVLGGVGDRRNVNESRSLFSMPPGFDQMNEFEAEKTNASSSEWDANGLIGLPGLGLGGKQKSFADIFQPDMGHPVSQQPSRPASRNAFDENVDSTNNQSPSASQGIGAPPPYSYAAVLGSSLSRNGTPDPQAVARVPSPCLTPIGSGRVSSNDKRNTSNQSPFNGVTSGLNESSDLVNALSGMNLSGSGGLDDRGQAEQDVEKVRNYMFGFQGGHNEVSQHVFPNKSDQAQKATGSLRNLHMRGSQGSAYNGGGLANPYQHLDSPNYCLNNYALNPAVASVMANQLGNSNFSPMYDNYSAASALGFSGMDSRLHGGGFESRNLGRSNRMMGGGGLQSHMADPMYHQYGRYSENVDALDLLNDPAMDRSFMGNSYMNMLELQRAYLGAQKSQYGVPYKSGSPNSHSYYGSPTFGSNMSYPGSPLAHHAMQNSLMSPCSPMRRGEVNMRYPSATRNYSGGVMGSWHMDASLDEGFGSSLLEEFKSNKTRGFELSEIAGHVVEFSADQYGSRFIQQKLETATTDEKNMVYEEIMPHALALMTDVFGNYVIQKFFEHGLPPQRRELGDKLFENVLPLSLQMYGCRVIQKAIEVVDLDQKIKMVKELDGHVMRCVRDQNGNHVVQKCIECVPEENIEFIISTFFGHVVSLSTHPYGCRVIQRVLEHCHDPDTQSKVMEEILSTVSMLAQDQYGNYVVQHVLEHGKPDERTVIIKELAGKIVQMSQQKFASNVVEKCLTFGGPEERELLVNEMLGTTDENEPLQAMMKDQFANYVVQKVLETCDDQQRELILTRIKVHLNALKKYTYGKHVVARIEKLVAAGGMHMFLLFPLGLKEENGFAVPNPASDVVRPQVLYSLTRVDGSAIAF

SEQ ID NO: 149 - protein, 320 aa, Artificial Sequence
  Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQ

SEQ ID NO: 150 - protein, 400 aa, Artificial Sequence
  Elastin-like polypeptide
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 151 - protein, 720 aa, Artificial Sequence
  Elastin-like polypeptide
GRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGRGDQPYQGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 152 - protein, 12 aa, Artificial Sequence
  linker
GKSSGSGSESKS

SEQ ID NO: 153 - protein, 14 aa, Artificial Sequence
  linker
GSTSGSGKSSEGKG

SEQ ID NO: 154 - protein, 18 aa, Artificial Sequence
  linker
GSTSGSGKSSEGSGSTKG

SEQ ID NO: 155 - protein, 18 aa, Artificial Sequence
  linker
GSTSGSGKPGSGEGSTKG

SEQ ID NO: 156 - protein, 14 aa, Artificial Sequence
  linker
EGKSSGSGSESKEF

SEQ ID NO: 157 - protein, 5 aa, Artificial Sequence
  linker
SRSSG

SEQ ID NO: 158 - protein, 5 aa, Artificial Sequence
  linker
SGSSC

SEQ ID NO: 159 - protein, 18 aa, Artificial Sequence
  linker
EGRGSLLTCGDVEENPGP

SEQ ID NO: 160 - protein, 19 aa, Artificial Sequence
  linker
ATNFSLLKQAGDVEENPGP

SEQ ID NO: 161 - protein, 20 aa, Artificial Sequence
  linker
QCTNYALLKLAGDVESNPGP

SEQ ID NO: 162 - protein, 22 aa, Artificial Sequence
  linker
VKQTLNFDLLKLAGDVESNPGP

SEQ ID NO: 163 - protein, 3 aa, Artificial Sequence
  linker
GSG

SEQ ID NO: 164 - protein, 400 aa, Artificial Sequence
  Elastin-like polypeptide
GVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVP

SEQ ID NO: 165 - protein, 320 aa, Artificial Sequence
  Resilin-like polypeptide
GRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYS

SEQ ID NO: 166 - protein, 96 aa, Homo sapiens
NRPPIAIVSPQFQEISLPTTSTVIDGSQSTDDDKIVQYHWEELKGPLREEKISEDTAILKLSKLVPGNYTFSLTVVDSDGATNSTTANLTVNKAVD

SEQ ID NO: 167 - protein, 122 aa, Artificial Sequence
  capture domain
GITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPS

SEQ ID NO: 168 - protein, 43 aa, Artificial Sequence
  capture domain
GPLGSVTCKSGDFSCGGRVNRCIPQFWRCDGQVDCDNGSDEQG

SEQ ID NO: 169 - protein, 37 aa, Artificial Sequence
  capture domain
TCSQDEFRCHDGKCISRQFVCDSDRDCLDGSDEASCP

SEQ ID NO: 170 - protein, 50 aa, Artificial Sequence
  capture domain
LAEAKVLANRELDKYGVSDFYKRLINKAKTVEGVEALKLHILAALPGGWP

SEQ ID NO: 171 - protein, 59 aa, Artificial Sequence
  capture domain
VDNKFNKEQQNAFYEILHLPNLNEEQRNAFIQSLKDDPSQSANLLAEAKKLNDAQAPKG

SEQ ID NO: 172 - protein, 505 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPG

SEQ ID NO: 173 - protein, 530 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGGITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGY

SEQ ID NO: 174 - protein, 451 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGGPLGSVTCKSGDFSCGGRVNRCIPQFWRCDGQVDCDNGSDEQGGY

SEQ ID NO: 175 - protein, 445 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGTCSQDEFRCHDGKCISRQFVCDSDRDCLDGSDEASCPGY

SEQ ID NO: 176 - protein, 456 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGLAEAKVLANRELDKYGVSDFYKRLINKAKTVEGVEALKLHILAALPGGWP

SEQ ID NO: 177 - protein, 465 aa, Artificial Sequence
  purification matrix
MSKGPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVGVPGLGVPGVGVPGLGVPGVGVPGVDNKFNKEQQNAFYEILHLPNLNEEQRNAFIQSLKDDPSQSANLLAEAKKLNDAQAPKG

SEQ ID NO: 178 - protein, 385 aa, Artificial Sequence
  purification matrix
MSKGPGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGRGDSPYSGVDNKFNKEQQNAFYEILHLPNLNEEQRNAFIQSLKDDPSQSANLLAEAKKLNDAQAPKG

SEQ ID NO: 179 - protein, 58 aa, Staphylococcus aureus [sequence omitted]

SEQ ID NO: 180 - protein, 3500 aa, Artificial Sequence
  resilin-like polypeptide
  SITE (8)..(3500): May be present or absent in groups of the repeat unit Gly Arg Gly Asp Ser Pro Tyr
GRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPYGRGDSPY

SEQ ID NO: 181 - protein, 3500 aa, Artificial Sequence
  resilin-like polypeptide
  SITE (8)..(3500): May be present or absent in groups of the repeat unit Gly Arg Gly Asp Ser Pro His
GRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPHGRGDSPH

SEQ ID NO: 182 - protein, 3500 aa, Artificial Sequence
  resilin-like polypeptide
  SITE (8)..(3500): May be present or absent in groups of the repeat unit Gly Arg Gly Asp Ser Pro Val
GRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPVGRGDSPV

SEQ ID NO: 183 - protein, 4000 aa, Artificial Sequence
  resilin-like polypeptide
  SITE (9)..(4000): May be present or absent in groups of the repeat unit Gly Arg Gly Asp Ser Pro Tyr Gly
GRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYGGRGDSPYG

SEQ ID NO: 184 - protein, 3500 aa, Artificial Sequence
  resilin-like polypeptide
  SITE (8)..(3500): May be present or absent in groups of the repeat unit Arg Pro Leu Gly Tyr Asp Ser
RPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDSRPLGYDS

SEQ ID NO: 185 - protein, 3500 aa, Artificial Sequence
  resilin-like polypeptide
  SITE (8)..(3500): May be present or absent in groups of the repeat unit Arg Pro Ala Gly Tyr Asp Ser
RPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDSRPAGYDS

SEQ ID NO: 186 - protein, 3500 aa, Artificial Sequence
  resilin-like polypeptide
  SITE (8)..(3500): May be present or absent in groups of the repeat unit Gly Arg Gly Asp Ser Tyr Pro
GRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYPGRGDSYP

SEQ ID NO: 187 - protein, 4000 aa, Artificial Sequence
  resilin-like polypeptide
  SITE (9)..(4000): May be present or absent in groups of the repeat unit Gly Arg Gly Asp Ser Pro Tyr Gln
GRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQGRGDSPYQ

SEQ ID NO: 188 - protein, 4000 aa, Artificial Sequence
  resilin-like polypeptide
  SITE (9)..(4000): May be present or absent in groups of the repeat unit Gly Arg Gly Asn Ser Pro Tyr Gly
GRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYGGRGNSPYG

SEQ ID NO: 189 - protein, 2500 aa, Artificial Sequence
  elastin-like polypeptide
  SITE (4)..(4): Xaa can be any amino acid
  SITE (6)..(2500): May be present or absent in groups of the repeat unit Val Pro Gly Xaa Gly
  SITE (9)..(9): Xaa can be any amino acid
  SITE (14)..(14): Xaa can be any amino acid
  SITE (19)..(19): Xaa can be any amino acid
  SITE (24)..(24): Xaa can be any amino acid
  SITE (29)..(29): Xaa can be any amino acid
  SITE (34)..(34): Xaa can be any amino acid
  SITE (39)..(39): Xaa can be any amino acid
  SITE (44)..(44): Xaa can be any amino acid
  SITE (49)..(49): Xaa can be any amino acid
  SITE (54)..(54): Xaa can be any amino acid
  SITE (59)..(59): Xaa can be any amino acid
  SITE (64)..(64): Xaa can be any amino acid
  SITE (69)..(69): Xaa can be any amino acid
  SITE (74)..(74): Xaa can be any amino acid
  SITE (79)..(79): Xaa can be any amino acid
  SITE (84)..(84): Xaa can be any amino acid
  SITE (89)..(89): Xaa can be any amino acid
  SITE (94)..(94): Xaa can be any amino acid
  SITE (99)..(99): Xaa can be any amino acid
  SITE (104)..(104): Xaa can be any amino acid
  SITE (109)..(109): Xaa can be any amino acid
  SITE (114)..(114): Xaa can be any amino acid
  SITE (119)..(119): Xaa can be any amino acid
  SITE (124)..(124): Xaa can be any amino acid
  SITE (129)..(129): Xaa can be any amino acid
  SITE (134)..(134): Xaa can be any amino acid
  SITE (139)..(139): Xaa can be any amino acid
  SITE (144)..(144): Xaa can be any amino acid
  SITE (149)..(149): Xaa can be any amino acid
  SITE (154)..(154): Xaa can be any amino acid
  SITE (159)..(159): Xaa can be any amino acid
  SITE (164)..(164): Xaa can be any amino acid
  SITE (169)..(169): Xaa can be any amino acid
  SITE (174)..(174): Xaa can be any amino acid
  SITE (179)..(179): Xaa can be any amino acid
  SITE (184)..(184): Xaa can be any amino acid
  SITE (189)..(189): Xaa can be any amino acid
  SITE (194)..(194): Xaa can be any amino acid
  SITE (199)..(199): Xaa can be any amino acid
  SITE (204)..(204): Xaa can be any amino acid
  SITE (209)..(209): Xaa can be any amino acid
  SITE (214)..(214): Xaa can be any amino acid
  SITE (219)..(219): Xaa can be any amino acid
  SITE (224)..(224): Xaa can be any amino acid
  SITE (229)..(229): Xaa can be any amino acid
  SITE (234)..(234): Xaa can be any amino acid
  SITE (239)..(239): Xaa can be any amino acid
  SITE (244)..(244): Xaa can be any amino acid
  SITE (249)..(249): Xaa can be any amino acid
  SITE (254)..(254): Xaa can be any amino acid
  SITE (259)..(259): Xaa can be any amino acid
  SITE (264)..(264): Xaa can be any amino acid
  SITE (269)..(269): Xaa can be any amino acid
  SITE (274)..(274): Xaa can be any amino acid
  SITE (279)..(279): Xaa can be any amino acid
  SITE (284)..(284): Xaa can be any amino acid
  SITE (289)..(289): Xaa can be any amino acid
  SITE (294)..(294): Xaa can be any amino acid
  SITE (299)..(299): Xaa can be any amino acid
  SITE (304)..(304): Xaa can be any amino acid
  SITE (309)..(309): Xaa can be any amino acid
  SITE (314)..(314): Xaa can be any amino acid
  SITE (319)..(319): Xaa can be any amino acid
  SITE (324)..(324): Xaa can be any amino acid
  SITE (329)..(329): Xaa can be any amino acid
  SITE (334)..(334): Xaa can be any amino acid
  SITE (339)..(339): Xaa can be any amino acid
  SITE (344)..(344): Xaa can be any amino acid
  SITE (349)..(349): Xaa can be any amino acid
  SITE (354)..(354): Xaa can be any amino acid
  SITE (359)..(359): Xaa can be any amino acid
  SITE (364)..(364): Xaa can be any amino acid
  SITE (369)..(369): Xaa can be any amino acid
  SITE (374)..(374): Xaa can be any amino acid
  SITE (379)..(379): Xaa can be any amino acid
  SITE (384)..(384): Xaa can be any amino acid
  SITE (389)..(389): Xaa can be any amino acid
  SITE (394)..(394): Xaa can be any amino acid
  SITE (399)..(399): Xaa can be any amino acid
  SITE (404)..(404): Xaa can be any amino acid
  SITE (409)..(409): Xaa can be any amino acid
  SITE (414)..(414): Xaa can be any amino acid
  SITE (419)..(419): Xaa can be any amino acid
  SITE (424)..(424): Xaa can be any amino acid
  SITE (429)..(429): Xaa can be any amino acid
  SITE (434)..(434): Xaa can be any amino acid
  SITE (439)..(439): Xaa can be any amino acid
  SITE (444)..(444): Xaa can be any amino acid
  SITE (449)..(449): Xaa can be any amino acid
  SITE (454)..(454): Xaa can be any amino acid
  SITE (459)..(459): Xaa can be any amino acid
  SITE (464)..(464): Xaa can be any amino acid
  SITE (469)..(469): Xaa can be any amino acid
  SITE (474)..(474): Xaa can be any amino acid
  SITE (479)..(479): Xaa can be any amino acid
  SITE (484)..(484): Xaa can be any amino acid
  SITE (489)..(489): Xaa can be any amino acid
  SITE (494)..(494): Xaa can be any amino acid
  SITE (499)..(499): Xaa can be any amino acid
  SITE (504)..(504): Xaa can be any amino acid
  SITE (509)..(509): Xaa can be any amino acid
  SITE (514)..(514): Xaa can be any amino acid
  SITE (519)..(519): Xaa can be any amino acid
  SITE (524)..(524): Xaa can be any amino acid
  SITE (529)..(529): Xaa can be any amino acid
  SITE (534)..(534): Xaa can be any amino acid
  SITE (539)..(539): Xaa can be any amino acid
  SITE (544)..(544): Xaa can be any amino acid
  SITE (549)..(549): Xaa can be any amino acid
  SITE (554)..(554): Xaa can be any amino acid
  SITE (559)..(559): Xaa can be any amino acid
  SITE (564)..(564): Xaa can be any amino acid
  SITE (569)..(569): Xaa can be any amino acid
  SITE (574)..(574): Xaa can be any amino acid
  SITE (579)..(579): Xaa can be any amino acid
  SITE (584)..(584): Xaa can be any amino acid
  SITE (589)..(589): Xaa can be any amino acid
  SITE (594)..(594): Xaa can be any amino acid
  SITE (599)..(599): Xaa can be any amino acid
  SITE (604)..(604): Xaa can be any amino acid
  SITE (609)..(609): Xaa can be any amino acid
  SITE (614)..(614): Xaa can be any amino acid
  SITE (619)..(619): Xaa can be any amino acid
  SITE (624)..(624): Xaa can be any amino acid
  SITE (629)..(629): Xaa can be any amino acid
  SITE (634)..(634): Xaa can be any amino acid
  SITE (639)..(639): Xaa can be any amino acid
  SITE (644)..(644): Xaa can be any amino acid
  SITE (649)..(649): Xaa can be any amino acid
  SITE (654)..(654): Xaa can be any amino acid
  SITE (659)..(659): Xaa can be any amino acid
  SITE (664)..(664): Xaa can be any amino acid
  SITE (669)..(669): Xaa can be any amino acid
  SITE (674)..(674): Xaa can be any amino acid
  SITE (679)..(679): Xaa can be any amino acid
  SITE (684)..(684): Xaa can be any amino acid
  SITE (689)..(689): Xaa can be any amino acid
  SITE (694)..(694): Xaa can be any amino acid
  SITE (699)..(699): Xaa can be any amino acid
  SITE (704)..(704): Xaa can be any amino acid
  SITE (709)..(709): Xaa can be any amino acid
  SITE (714)..(714): Xaa can be any amino acid
  SITE (719)..(719): Xaa can be any amino acid
  SITE (724)..(724): Xaa can be any amino acid
  SITE (729)..(729): Xaa can be any amino acid
  SITE (734)..(734): Xaa can be any amino acid
  SITE (739)..(739): Xaa can be any amino acid
  SITE (744)..(744): Xaa can be any amino acid
  SITE (749)..(749): Xaa can be any amino acid
  SITE (754)..(754): Xaa can be any amino acid
  SITE (759)..(759): Xaa can be any amino acid
  SITE (764)..(764): Xaa can be any amino acid
  SITE (769)..(769): Xaa can be any amino acid
  SITE (774)..(774): Xaa can be any amino acid
  SITE (779)..(779): Xaa can be any amino acid
  SITE (784)..(784): Xaa can be any amino acid
  SITE (789)..(789): Xaa can be any amino acid
  SITE (794)..(794): Xaa can be any amino acid
  SITE (799)..(799): Xaa can be any amino acid
  SITE (804)..(804): Xaa can be any amino acid
  SITE (809)..(809): Xaa can be any amino acid
  SITE (814)..(814): Xaa can be any amino acid
  SITE (819)..(819): Xaa can be any amino acid
  SITE (824)..(824): Xaa can be any amino acid
  SITE (829)..(829): Xaa can be any amino acid
  SITE (834)..(834): Xaa can be any amino acid
  SITE (839)..(839): Xaa can be any amino acid
  SITE (844)..(844): Xaa can be any amino acid
  SITE (849)..(849): Xaa can be any amino acid
  SITE (854)..(854): Xaa can be any amino acid
  SITE (859)..(859): Xaa can be any amino acid
  SITE (864)..(864): Xaa can be any amino acid
  SITE (869)..(869): Xaa can be any amino acid
  SITE (874)..(874): Xaa can be any amino acid
  SITE (879)..(879): Xaa can be any amino acid
  SITE (884)..(884): Xaa can be any amino acid
  SITE (889)..(889): Xaa can be any amino acid
  SITE (894)..(894): Xaa can be any amino acid
  SITE (899)..(899): Xaa can be any amino acid
  SITE (904)..(904): Xaa can be any amino acid
  SITE (909)..(909): Xaa can be any amino acid
  SITE (914)..(914): Xaa can be any amino acid
  SITE (919)..(919): Xaa can be any amino acid
  SITE (924)..(924): Xaa can be any amino acid
  SITE (929)..(929): Xaa can be any amino acid
  SITE (934)..(934): Xaa can be any amino acid
  SITE (939)..(939): Xaa can be any amino acid
  SITE (944)..(944): Xaa can be any amino acid
  SITE (949)..(949): Xaa can be any amino acid
  SITE (954)..(954): Xaa can be any amino acid
  SITE (959)..(959): Xaa can be any amino acid
  SITE (964)..(964): Xaa can be any amino acid
  SITE (969)..(969): Xaa can be any amino acid
  SITE (974)..(974): Xaa can be any amino acid
  SITE (979)..(979): Xaa can be any amino acid
  SITE (984)..(984): Xaa can be any amino acid
  SITE (989)..(989): Xaa can be any amino acid
  SITE (994)..(994): Xaa can be any amino acid
  SITE (999)..(999): Xaa can be any amino acid
  SITE (1004)..(1004): Xaa can be any amino acid
  SITE (1009)..(1009): Xaa can be any amino acid
  SITE (1014)..(1014): Xaa can be any amino acid
  SITE (1019)..(1019): Xaa can be any amino acid
  SITE (1024)..(1024): Xaa can be any amino acid
  SITE (1029)..(1029): Xaa can be any amino acid
  SITE (1034)..(1034): Xaa can be any amino acid
  SITE (1039)..(1039): Xaa can be any amino acid
  SITE (1044)..(1044): Xaa can be any amino acid
  SITE (1049)..(1049): Xaa can be any amino acid
  SITE (1054)..(1054): Xaa can be any amino acid
  SITE (1059)..(1059): Xaa can be any amino acid
  SITE (1064)..(1064): Xaa can be any amino acid
  SITE (1069)..(1069): Xaa can be any amino acid
  SITE (1074)..(1074): Xaa can be any amino acid
  SITE (1079)..(1079): Xaa can be any amino acid
  SITE (1084)..(1084): Xaa can be any amino acid
  SITE (1089)..(1089): Xaa can be any amino acid
  SITE (1094)..(1094): Xaa can be any amino acid
  SITE (1099)..(1099): Xaa can be any amino acid
  SITE (1104)..(1104): Xaa can be any amino acid
  SITE (1109)..(1109): Xaa can be any amino acid
  SITE (1114)..(1114): Xaa can be any amino acid
  SITE (1119)..(1119): Xaa can be any amino acid
  SITE (1124)..(1124): Xaa can be any amino acid
  SITE (1129)..(1129): Xaa can be any amino acid
  SITE (1134)..(1134): Xaa can be any amino acid
  SITE (1139)..(1139): Xaa can be any amino acid
  SITE (1144)..(1144): Xaa can be any amino acid
  SITE (1149)..(1149): Xaa can be any amino acid
  SITE (1154)..(1154): Xaa can be any amino acid
  SITE (1159)..(1159): Xaa can be any amino acid
  SITE (1164)..(1164): Xaa can be any amino acid
  SITE (1169)..(1169): Xaa can be any amino acid
  SITE (1174)..(1174): Xaa can be any amino acid
  SITE (1179)..(1179): Xaa can be any amino acid
  SITE (1184)..(1184): Xaa can be any amino acid
  SITE (1189)..(1189): Xaa can be any amino acid
  SITE (1194)..(1194): Xaa can be any amino acid
  SITE (1199)..(1199): Xaa can be any amino acid
  SITE (1204)..(1204): Xaa can be any amino acid
  SITE (1209)..(1209): Xaa can be any amino acid
  SITE (1214)..(1214): Xaa can be any amino acid
  SITE (1219)..(1219): Xaa can be any amino acid
  SITE (1224)..(1224): Xaa can be any amino acid
  SITE (1229)..(1229): Xaa can be any amino acid
  SITE (1234)..(1234): Xaa can be any amino acid
  SITE (1239)..(1239): Xaa can be any amino acid
  SITE (1244)..(1244): Xaa can be any amino acid
  SITE (1249)..(1249): Xaa can be any amino acid
  SITE (1254)..(1254): Xaa can be any amino acid
  SITE (1259)..(1259): Xaa can be any amino acid
  SITE (1264)..(1264): Xaa can be any amino acid
  SITE (1269)..(1269): Xaa can be any amino acid
  SITE (1274)..(1274): Xaa can be any amino acid
  SITE (1279)..(1279): Xaa can be any amino acid
  SITE (1284)..(1284): Xaa can be any amino acid
  SITE (1289)..(1289): Xaa can be any amino acid
  SITE (1294)..(1294): Xaa can be any amino acid
  SITE (1299)..(1299): Xaa can be any amino acid
  SITE (1304)..(1304): Xaa can be any amino acid
  SITE (1309)..(1309): Xaa can be any amino acid
  SITE (1314)..(1314): Xaa can be any amino acid
  SITE (1319)..(1319): Xaa can be any amino acid
  SITE (1324)..(1324): Xaa can be any amino acid
  SITE (1329)..(1329): Xaa can be any amino acid
  SITE (1334)..(1334): Xaa can be any amino acid
  SITE (1339)..(1339): Xaa can be any amino acid
  SITE (1344)..(1344): Xaa can be any amino acid
  SITE (1349)..(1349): Xaa can be any amino acid
  SITE (1354)..(1354): Xaa can be any amino acid
  SITE (1359)..(1359): Xaa can be any amino acid
  SITE (1364)..(1364): Xaa can be any amino acid
  SITE (1369)..(1369): Xaa can be any amino acid
  SITE (1374)..(1374): Xaa can be any amino acid
  SITE (1379)..(1379): Xaa can be any amino acid
  SITE (1384)..(1384): Xaa can be any amino acid
  SITE (1389)..(1389): Xaa can be any amino acid
  SITE (1394)..(1394): Xaa can be any amino acid
  SITE (1399)..(1399): Xaa can be any amino acid
  SITE (1404)..(1404): Xaa can be any amino acid
  SITE (1409)..(1409): Xaa can be any amino acid
  SITE (1414)..(1414): Xaa can be any amino acid
  SITE (1419)..(1419): Xaa can be any amino acid
  SITE (1424)..(1424): Xaa can be any amino acid
  SITE (1429)..(1429): Xaa can be any amino acid
  SITE (1434)..(1434): Xaa can be any amino acid
  SITE (1439)..(1439): Xaa can be any amino acid
  SITE (1444)..(1444): Xaa can be any amino acid
  SITE (1449)..(1449): Xaa can be any amino acid
  SITE (1454)..(1454): Xaa can be any amino acid
  SITE (1459)..(1459): Xaa can be any amino acid
  SITE (1464)..(1464): Xaa can be any amino acid
  SITE (1469)..(1469): Xaa can be any amino acid
  SITE (1474)..(1474): Xaa can be any amino acid
  SITE (1479)..(1479): Xaa can be any amino acid
  SITE (1484)..(1484): Xaa can be any amino acid
  SITE (1489)..(1489): Xaa can be any amino acid
  SITE (1494)..(1494): Xaa can be any amino acid
  SITE (1499)..(1499): Xaa can be any amino acid
  SITE (1504)..(1504): Xaa can be any amino acid
  SITE (1509)..(1509): Xaa can be any amino acid
  SITE (1514)..(1514): Xaa can be any amino acid
  SITE (1519)..(1519): Xaa can be any amino acid
  SITE (1524)..(1524): Xaa can be any amino acid
  SITE (1529)..(1529): Xaa can be any amino acid
  SITE (1534)..(1534): Xaa can be any amino acid
  SITE (1539)..(1539): Xaa can be any amino acid
  SITE (1544)..(1544): Xaa can be any amino acid
  SITE (1549)..(1549): Xaa can be any amino acid
  SITE (1554)..(1554): Xaa can be any amino acid
  SITE (1559)..(1559): Xaa can be any amino acid
  SITE (1564)..(1564): Xaa can be any amino acid
  SITE (1569)..(1569): Xaa can be any amino acid
  SITE (1574)..(1574): Xaa can be any amino acid
  SITE (1579)..(1579): Xaa can be any amino acid
  SITE (1584)..(1584): Xaa can be any amino acid
  SITE (1589)..(1589): Xaa can be any amino acid
  SITE (1594)..(1594): Xaa can be any amino acid
  SITE (1599)..(1599): Xaa can be any amino acid
  SITE (1604)..(1604): Xaa can be any amino acid
  SITE (1609)..(1609): Xaa can be any amino acid
  SITE (1614)..(1614): Xaa can be any amino acid
  SITE (1619)..(1619): Xaa can be any amino acid
  SITE (1624)..(1624): Xaa can be any amino acid
  SITE (1629)..(1629): Xaa can be any amino acid
  SITE (1634)..(1634): Xaa can be any amino acid
  SITE (1639)..(1639): Xaa can be any amino acid
  SITE (1644)..(1644): Xaa can be any amino acid
  SITE (1649)..(1649): Xaa can be any amino acid
  SITE (1654)..(1654): Xaa can be any amino acid
  SITE (1659)..(1659): Xaa can be any amino acid
  SITE (1664)..(1664): Xaa can be any amino acid
  SITE (1669)..(1669): Xaa can be any amino acid
  SITE (1674)..(1674): Xaa can be any amino acid
  SITE (1679)..(1679): Xaa can be any amino acid
  SITE (1684)..(1684): Xaa can be any amino acid
  SITE (1689)..(1689): Xaa can be any amino acid
  SITE (1694)..(1694): Xaa can be any amino acid
  SITE (1699)..(1699): Xaa can be any amino acid
  SITE (1704)..(1704): Xaa can be any amino acid
  SITE (1709)..(1709): Xaa can be any amino acid
  SITE (1714)..(1714): Xaa can be any amino acid
  SITE (1719)..(1719): Xaa can be any amino acid
  SITE (1724)..(1724): Xaa can be any amino acid
  SITE (1729)..(1729): Xaa can be any amino acid
  SITE (1734)..(1734): Xaa can be any amino acid
  SITE (1739)..(1739): Xaa can be any amino acid
  SITE (1744)..(1744): Xaa can be any amino acid
  SITE (1749)..(1749): Xaa can be any amino acid
  SITE (1754)..(1754): Xaa can be any amino acid
  SITE (1759)..(1759): Xaa can be any amino acid
  SITE (1764)..(1764): Xaa can be any amino acid
  SITE (1769)..(1769): Xaa can be any amino acid
  SITE (1774)..(1774): Xaa can be any amino acid
  SITE (1779)..(1779): Xaa can be any amino acid
  SITE (1784)..(1784): Xaa can be any amino acid
  SITE (1789)..(1789): Xaa can be any amino acid
  SITE (1794)..(1794): Xaa can be any amino acid
  SITE (1799)..(1799): Xaa can be any amino acid
  SITE (1804)..(1804): Xaa can be any amino acid
  SITE (1809)..(1809): Xaa can be any amino acid
  SITE (1814)..(1814): Xaa can be any amino acid
  SITE (1819)..(1819): Xaa can be any amino acid
  SITE (1824)..(1824): Xaa can be any amino acid
  SITE (1829)..(1829): Xaa can be any amino acid
  SITE (1834)..(1834): Xaa can be any amino acid
  SITE (1839)..(1839): Xaa can be any amino acid
  SITE (1844)..(1844): Xaa can be any amino acid
  SITE (1849)..(1849): Xaa can be any amino acid
  SITE (1854)..(1854): Xaa can be any amino acid
  SITE (1859)..(1859): Xaa can be any amino acid
  SITE (1864)..(1864): Xaa can be any amino acid
  SITE (1869)..(1869): Xaa can be any amino acid
  SITE (1874)..(1874): Xaa can be any amino acid
  SITE (1879)..(1879): Xaa can be any amino acid
  SITE (1884)..(1884): Xaa can be any amino acid
  SITE (1889)..(1889): Xaa can be any amino acid
  SITE (1894)..(1894): Xaa can be any amino acid
  SITE (1899)..(1899): Xaa can be any amino acid
  SITE (1904)..(1904): Xaa can be any amino acid
  SITE (1909)..(1909): Xaa can be any amino acid
  SITE (1914)..(1914): Xaa can be any amino acid
  SITE (1919)..(1919): Xaa can be any amino acid
  SITE (1924)..(1924): Xaa can be any amino acid
  SITE (1929)..(1929): Xaa can be any amino acid
  SITE (1934)..(1934): Xaa can be any amino acid
  SITE (1939)..(1939): Xaa can be any amino acid
  SITE (1944)..(1944): Xaa can be any amino acid
  SITE (1949)..(1949): Xaa can be any amino acid
  SITE (1954)..(1954): Xaa can be any amino acid
  SITE (1959)..(1959): Xaa can be any amino acid
  SITE (1964)..(1964): Xaa can be any amino acid
  SITE (1969)..(1969): Xaa can be any amino acid
  SITE (1974)..(1974): Xaa can be any amino acid
  SITE (1979)..(1979): Xaa can be any amino acid
  SITE (1984)..(1984): Xaa can be any amino acid
  SITE (1989)..(1989): Xaa can be any amino acid
  SITE (1994)..(1994): Xaa can be any amino acid
  SITE (1999)..(1999): Xaa can be any amino acid
  SITE (2004)..(2004): Xaa can be any amino acid
  SITE (2009)..(2009): Xaa can be any amino acid
  SITE (2014)..(2014): Xaa can be any amino acid
  SITE (2019)..(2019): Xaa can be any amino acid
  SITE (2024)..(2024): Xaa can be any amino acid
  SITE (2029)..(2029): Xaa can be any amino acid
  SITE (2034)..(2034): Xaa can be any amino acid
  SITE (2039)..(2039): Xaa can be any amino acid
  SITE (2044)..(2044): Xaa can be any amino acid
  SITE (2049)..(2049): Xaa can be any amino acid
  SITE (2054)..(2054): Xaa can be any amino acid
  SITE (2059)..(2059): Xaa can be any amino acid
  SITE (2064)..(2064): Xaa can be any amino acid
  SITE (2069)..(2069): Xaa can be any amino acid
  SITE (2074)..(2074): Xaa can be any amino acid
  SITE (2079)..(2079): Xaa can be any amino acid
  SITE (2084)..(2084): Xaa can be any amino acid
  SITE (2089)..(2089): Xaa can be any amino acid
  SITE (2094)..(2094): Xaa can be any amino acid
  SITE (2099)..(2099): Xaa can be any amino acid
  SITE (2104)..(2104): Xaa can be any amino acid
  SITE (2109)..(2109): Xaa can be any amino acid
  SITE (2114)..(2114): Xaa can be any amino acid
  SITE (2119)..(2119): Xaa can be any amino acid
  SITE (2124)..(2124): Xaa can be any amino acid
  SITE (2129)..(2129): Xaa can be any amino acid
  SITE (2134)..(2134): Xaa can be any amino acid
  SITE (2139)..(2139): Xaa can be any amino acid
  SITE (2144)..(2144): Xaa can be any amino acid
  SITE (2149)..(2149): Xaa can be any amino acid
  SITE (2154)..(2154): Xaa can be any amino acid
  SITE (2159)..(2159): Xaa can be any amino acid
  SITE (2164)..(2164): Xaa can be any amino acid
  SITE (2169)..(2169): Xaa can be any amino acid
  SITE (2174)..(2174): Xaa can be any amino acid
  SITE (2179)..(2179): Xaa can be any amino acid
  SITE (2184)..(2184): Xaa can be any amino acid
  SITE (2189)..(2189): Xaa can be any amino acid
  SITE (2194)..(2194): Xaa can be any amino acid
  SITE (2199)..(2199): Xaa can be any amino acid
  SITE (2204)..(2204): Xaa can be any amino acid
  SITE (2209)..(2209): Xaa can be any amino acid
  SITE (2214)..(2214): Xaa can be any amino acid
  SITE (2219)..(2219): Xaa can be any amino acid
  SITE (2224)..(2224): Xaa can be any amino acid
  SITE (2229)..(2229): Xaa can be any amino acid
  SITE (2234)..(2234): Xaa can be any amino acid
  SITE (2239)..(2239): Xaa can be any amino acid
  SITE (2244)..(2244): Xaa can be any amino acid
  SITE (2249)..(2249): Xaa can be any amino acid
  SITE (2254)..(2254): Xaa can be any amino acid
  SITE (2259)..(2259): Xaa can be any amino acid
  SITE (2264)..(2264): Xaa can be any amino acid
  SITE (2269)..(2269): Xaa can be any amino acid
  SITE (2274)..(2274): Xaa can be any amino acid
  SITE (2279)..(2279): Xaa can be any amino acid
  SITE (2284)..(2284): Xaa can be any amino acid
  SITE (2289)..(2289): Xaa can be any amino acid
  SITE (2294)..(2294): Xaa can be any amino acid
  SITE (2299)..(2299): Xaa can be any amino acid
  SITE (2304)..(2304): Xaa can be any amino acid
  SITE (2309)..(2309): Xaa can be any amino acid
  SITE (2314)..(2314): Xaa can be any amino acid
  SITE (2319)..(2319): Xaa can be any amino acid
  SITE (2324)..(2324): Xaa can be any amino acid
  SITE (2329)..(2329): Xaa can be any amino acid
  SITE (2334)..(2334): Xaa can be any amino acid
  SITE (2339)..(2339): Xaa can be any amino acid
  SITE (2344)..(2344): Xaa can be any amino acid
  SITE (2349)..(2349): Xaa can be any amino acid
  SITE (2354)..(2354): Xaa can be any amino acid
  SITE (2359)..(2359): Xaa can be any amino acid
  SITE (2364)..(2364): Xaa can be any amino acid
  SITE (2369)..(2369): Xaa can be any amino acid
  SITE (2374)..(2374): Xaa can be any amino acid
  SITE (2379)..(2379): Xaa can be any amino acid
  SITE (2384)..(2384): Xaa can be any amino acid
  SITE (2389)..(2389): Xaa can be any amino acid
  SITE (2394)..(2394): Xaa can be any amino acid
  SITE (2399)..(2399): Xaa can be any amino acid
  SITE (2404)..(2404): Xaa can be any amino acid
  SITE (2409)..(2409): Xaa can be any amino acid
  SITE (2414)..(2414): Xaa can be any amino acid
  SITE (2419)..(2419): Xaa can be any amino acid
  SITE (2424)..(2424): Xaa can be any amino acid
  SITE (2429)..(2429): Xaa can be any amino acid
  SITE (2434)..(2434): Xaa can be any amino acid
  SITE (2439)..(2439): Xaa can be any amino acid
  SITE (2444)..(2444): Xaa can be any amino acid
  SITE (2449)..(2449): Xaa can be any amino acid
  SITE (2454)..(2454): Xaa can be any amino acid
  SITE (2459)..(2459): Xaa can be any amino acid
  SITE (2464)..(2464): Xaa can be any amino acid
  SITE (2469)..(2469): Xaa can be any amino acid
  SITE (2474)..(2474): Xaa can be any amino acid
  SITE (2479)..(2479): Xaa can be any amino acid
  SITE (2484)..(2484): Xaa can be any amino acid
  SITE (2489)..(2489): Xaa can be any amino acid
  SITE (2494)..(2494): Xaa can be any amino acid
  SITE (2499)..(2499): Xaa can be any amino acid
VPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXGVPGXG

SEQ ID NO: 190 - protein, 2500 aa, Artificial Sequence
  elastin-like polypeptide
  SITE (6)..(2500): May be present or absent in groups of the repeat unit Gly Val Gly Val Pro
GVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVP

SEQ ID NO: 191 - protein, 400 aa, Artificial Sequence; identical to SEQ ID NO: 164
  elastin-like polypeptide

SEQ ID NO: 192 - protein, 400 aa, Artificial Sequence
  elastin-like polypeptide
  SITE (101)..(400): May be present or absent
  SITE (201)..(400): May be present or absent
GVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVPGVGVPGVGVPGAGVPGVGVPGVGVP

SEQ ID NO: 193 - protein, 400 aa, Artificial Sequence; identical to SEQ ID NO: 192
  elastin-like polypeptide
  SITE (201)..(400): May be present or absent

What is claimed is:

1. A protein-based purification matrix comprising a fusion protein, wherein the fusion protein comprises:
at least one lentivirus-binding domain; and
(ii) at least one polypeptide with phase behavior;
wherein the lentivirus-binding domain comprises:
(a) amino acids 2-860 of SEQ ID NO: 73;
(b) amino acids 2-768 of SEQ ID NO: 74;
(c) amino acids 2-40 of SEQ ID NO: 75;
(d) amino acids 2-38 of SEQ ID NO: 76;
(e) SEQ ID NO: 168; or
(f) SEQ ID NO: 169.

2. The protein-based purification matrix of claim 1, wherein the protein-based purification matrix is bound to a viral particle, via the at least one lentivirus-binding domain of the protein-based purification matrix.

3. The protein-based purification matrix of claim 1, wherein the lentivirus-binding domain binds a lentivirus particle of the bovine, equine, feline, ovine, caprine, or primate serogroups.

4. The protein-based purification matrix of claim 1, wherein the lentivirus-binding domain comprises an amino acid sequence that is 100% identical to any one of SEQ ID NOs: 73-76.

5. The protein-based purification matrix of claim 1 wherein the lentivirus-binding domain comprises amino acids 2-40 of SEQ ID NO: 75.

6. The protein-based purification matrix of claim 1, wherein the lentivirus-binding domain comprises amino acids 2-38 of SEQ ID NO: 76.

7. The protein-based purification matrix of claim 1, wherein the polypeptide with phase behavior is an elastin-like polypeptide (ELP).

8. The protein-based purification matrix of claim 7, wherein the ELP is a polymer containing a pentapeptide repeat having the sequence (Val-Pro-Gly-Xaa-Gly)$_n$ (SEQ ID NO: 10);
wherein Xaa can be any amino acid except proline; and wherein n is an integer from 1 to 360, inclusive of endpoints.

9. The protein-based purification matrix of claim 1, wherein the polypeptide with phase behavior comprises an amino acid sequence selected from:

```
                                         (SEQ ID NO: 1)
(a)  (GRGDSPY)n;

(SEQ ID NO: 2)
(b)  (GRGDSPH)n;

(SEQ ID NO: 3)
(c)  (GRGDSPV)n;

(SEQ ID NO: 4)
(d)  (GRGDSPYG)n;

(SEQ ID NO: 5)
(e)  (RPLGYDS)n;

(SEQ ID NO: 6)
(f)  (RPAGYDS)n;

(SEQ ID NO: 7)
(g)  (GRGDSYP)n;

(SEQ ID NO: 8)
(h)  (GRGDSPYQ)n;

(SEQ ID NO: 9)
(i)  (GRGNSPYG)n;

(SEQ ID NO: 11)
(j)  (GVGVP)n;

(SEQ ID NO: 12)
(k)  (GVGVPGLGVPGVGVPGLGVPGVGVP)m;

(SEQ ID NO: 13)
(l)  (GVGVPGVGVPGAGVPGVGVPGVGVP)m;
```

-continued (m) (GVGVPGWGVPGVGVPGWGVPGVGVP)m; (SEQ ID NO: 14)

(n) (GVGVPGVGVPGVGVPGVGVPGVGVPGVGVPGEGVPGFGVPGVGVP)m; (SEQ ID NO: 15)

(o) (GVGVPGVGVPGVGVPGVGVPGVGVPGVGVPGKGVPGFGVPGVGVP)m; and (SEQ ID NO: 16)

(p) (GAGVPGVGVPGAGVPGVGVPGAGVP)m; (SEQ ID NO: 17)

wherein n is an integer in the range of 20-360, inclusive of endpoints; and m is an integer in the range of 4-25, inclusive of endpoints.

10. The protein-based purification matrix of claim 1, wherein the polypeptide with phase behavior comprises an amino acid sequence selected from:

(a) (GVGVP)$_m$; (SEQ ID NO: 52)

(b) (ZZPXXXGZ)$_m$; (SEQ ID NO: 57)

(c) (ZZPXGZ)$_m$; (SEQ ID NO: 58)

(d) (ZZPXXGZ)$_m$; or (SEQ ID NO: 59)

(e) (ZZPXXXGZ)$_m$; (SEQ ID NO: 60)

wherein m is an integer between 10 and 160, inclusive of endpoints;

wherein X if present is any amino acid except proline or glycine; and wherein Z if present is any amino acid.

11. The protein-based purification matrix of claim 1, wherein the polypeptide with phase behavior comprises an amino acid sequence selected from:

(a) (GVGVPGVGVPGAGVPGVGVPGVGVP)$_m$; and (SEQ ID NO: 53)

(b) (GVGVPGVGVPGLGVPGVGVPGVGVP)$_m$; (SEQ ID NO: 55)

wherein m is an integer between 2 and 32, inclusive of endpoints.

12. The protein-based purification matrix of claim 1, wherein the polypeptide with phase behavior comprises an amino acid sequence selected from:

(a) (GVGVPGVGVPGAGVPGVGVPGVGVP)$_m$ (SEQ ID NO: 193), wherein m is 8 or 16;

(b) (GVGVPGAGVP)$_m$ (SEQ ID NO: 54), wherein m is an integer between 5 and 80, inclusive of endpoints; and (c) (GXGVP)$_m$ (SEQ ID NO: 56), wherein m is an integer between 10 and 160, inclusive of endpoints, wherein each X is independently selected from the group consisting of glycine, alanine, valine, isoleucine, leucine, phenylalanine, tyrosine, tryptophan, lysine, arginine, aspartic acid, glutamic acid, and serine.

13. The protein-based purification matrix of claim 1, comprising the sequence of SEQ ID NO: 174 or 175.

14. A composition comprising the purification matrix of claim 1 and a lentiviral particle.

15. The protein-based purification matrix of claim 1, wherein the lentivirus-binding domain comprises amino acids 2-860 of SEQ ID NO: 73.

16. The protein-based purification matrix of claim 1, wherein the lentivirus-binding domain comprises amino acids 2-768 of SEQ ID NO: 74.

17. The protein-based purification matrix of claim 1, wherein the lentivirus-binding domain comprises the amino acid sequence of SEQ ID NO: 168.

18. The protein-based purification matrix of claim 1, wherein the lentivirus-binding domain comprises the amino acid sequence of SEQ ID NO: 169.

19. A method of purifying a viral particle comprising:
(i) contacting the viral particle with a protein-based purification matrix, wherein the protein-based purification matrix comprises a fusion protein that comprises:
 (a) at least one lentivirus-binding domain; and
 (b) at least one polypeptide with phase behavior;
 wherein the lentivirus-binding domain comprises the sequence of any one of SEQ ID NOs: 73-76 or 168-169, or a sequence with at least 90% identity thereto; and
 wherein the viral particle is a lentiviral particle, and wherein the viral particle binds to the protein-based purification matrix to form a complex;
(ii) contacting the complex with a first environmental factor to increase the size of the complex;
(iii) separating the complex from at least one contaminant on the basis of size; and
(iv) separating the viral particle from the protein-based purification matrix by contacting the complex with a second environmental factor.

20. The method of claim 19, wherein the lentivirus-binding domain comprises an amino acid sequence is 100% identical to any one of SEQ ID NOs: 73-76.

21. The method of claim 19, wherein the lentivirus-binding domain comprises amino acids 2-40 of SEQ ID NO: 75.

22. The method of claim 19, wherein the lentivirus-binding domain comprises amino acids 2-38 of SEQ ID NO: 76.

23. The method of claim 19, wherein the protein-based purification matrix comprises the sequence of SEQ ID NO: 174 or 175.

24. The method of claim 19, wherein in step (i), the protein-based purification matrix is added to a composition comprising cells producing viral particles and a tissue culture media.

25. The method of claim 19, wherein the first environmental factor comprises one or more of:
(a) a change in one or more of temperature, pH, salt concentration, concentration of the purification matrix, concentration of the viral particle, or pressure;
(b) the addition of one or more surfactants, cofactor, vitamin, molecular crowding agents, reducing agents, oxidizing agents, enzymes, or denaturing agents; or
(c) the application of electromagnetic or acoustic waves.

26. The method of claim 19, wherein the second environmental factor comprises one or more of:

(a) a change in one or more of temperature, pH, salt concentration, concentration of the purification matrix, concentration of the viral particle, or pressure;
(b) the addition of one or more surfactants, cofactor, vitamin, molecular crowding agents, reducing agents, oxidizing agents, enzymes, or denaturing agents; or
(c) the application of electromagnetic or acoustic waves.

27. The method of claim 19, wherein the separation on the basis of size is performed using tangential flow filtration, membrane chromatography, analytical ultracentrifugation, high performance liquid chromatography, membrane chromatography, normal flow filtration, acoustic wave separation, centrifugation, counterflow centrifugation, and fast protein liquid chromatography.

28. The method of claim 19, wherein the at least one contaminant is selected from a solvent, an endotoxin, a protein, a peptide, a nucleic acid, and a carbohydrate.

29. The method of claim 19, wherein a purification yield of the viral particle is at least 70%.

30. The method of claim 19, wherein the polypeptide with phase behavior of the protein-based purification matrix is an elastin-like polypeptide (ELP).

31. The method of claim 30, wherein the ELP of the protein-based purification matrix is a polymer containing a pentapeptide repeat having the sequence (Val-Pro-Gly-Xaa-Gly)$_n$ (SEQ ID NO: 10);
wherein Xaa can be any amino acid except proline; and
wherein n is an integer from 1 to 360, inclusive of endpoints.

32. The method of claim 19, wherein the polypeptide with phase behavior of the protein-based purification matrix comprises an amino acid sequence selected from:

(a) (GRGDSPY)$_n$; (SEQ ID NO: 1)

(b) (GRGDSPH)$_n$; (SEQ ID NO: 2)

(c) (GRGDSPV)$_n$; (SEQ ID NO: 3)

(d) (GRGDSPYG)$_n$; (SEQ ID NO: 4)

(e) (RPLGYDS)$_n$; (SEQ ID NO: 5)

(f) (RPAGYDS)$_n$; (SEQ ID NO: 6)

(g) (GRGDSYP)$_n$; (SEQ ID NO: 7)

(h) (GRGDSPYQ)$_n$; (SEQ ID NO: 8)

(i) (GRGNSPYG)$_n$; (SEQ ID NO: 9)

(j) (GVGVP)$_n$; (SEQ ID NO: 11)

(k) (GVGVPGLGVPGVGVPGLGVPGVGVP)$_m$; (SEQ ID NO: 12)

(l) (GVGVPGVGVPGAGVPGVGVPGVGVP)$_m$; (SEQ ID NO: 13)

(m) (GVGVPGWGVPGVGVPGWGVPGVGVP)$_m$; (SEQ ID NO: 14)

(n) (GVGVPGVGVPGVGVPGVGVPGVGVPGVGVPGEGVPGFGVPGVGVP)$_m$; (SEQ ID NO: 15)

(o) (GVGVPGVGVPGVGVPGVGVPGVGVPGVGVPGKGVPGFGVPGVGVP)$_m$; (SEQ ID NO: 16)

(p) (GAGVPGVGVPGAGVPGVGVPGAGVP)$_m$; (SEQ ID NO: 17)

wherein n is an integer in the range of 20-360, inclusive of endpoints; and
m is an integer in the range of 4-25, inclusive of endpoints.

33. The method of claim 19, wherein the polypeptide with phase behavior of the protein-based purification matrix comprises an amino acid sequence selected from:

(a) (GVGVP)$_m$; (SEQ ID NO: 52)

(b) (ZZPXXXGZ)$_m$; (SEQ ID NO: 57)

(c) (ZZPXGZ)$_m$; (SEQ ID NO: 58)

(d) (ZZPXXGZ)$_m$; or (SEQ ID NO: 59)

(e) (ZZPXXXGZ)$_m$; (SEQ ID NO: 60)

wherein m is an integer between 10 and 160, inclusive of endpoints;
wherein X if present is any amino acid except proline or glycine; and
wherein Z if present is any amino acid.

34. The method of claim 19, wherein the polypeptide with phase behavior of the protein-based purification matrix comprises an amino acid sequence selected from:

(a) (GVGVPGVGVPGAGVPGVGVPGVGVP)$_m$; and (SEQ ID NO: 53)

(b) (GVGVPGVGVPGLGVPGVGVPGVGVP)$_m$; (SEQ ID NO: 55)

wherein m is an integer between 2 and 32, inclusive of endpoints.

35. The method of claim 19, wherein the polypeptide with phase behavior of the protein-based purification matrix comprises an amino acid sequence selected from:
(a) (GVGVPGVGVPGAGVPGVGVPGVGVP)$_m$ (SEQ ID NO: 193), wherein m is 8 or 16;

(b) (GVGVPGAGVP)$_m$ (SEQ ID NO: 54), wherein m is an integer between 5 and 80, inclusive of endpoints; and (c) (GXGVP)$_m$ (SEQ ID NO: 56), wherein m is an integer between 10 and 160, inclusive of endpoints, wherein each X is independently selected from the group consisting of glycine, alanine, valine, isoleucine, leucine, phenylalanine, tyrosine, tryptophan, lysine, arginine, aspartic acid, glutamic acid, and serine.

36. The method of claim 19, wherein the lentivirus-binding domain of the protein-based purification matrix comprises a sequence selected from any one of:

(a) amino acids 2-860 of SEQ ID NO: 73;
(b) amino acids 2-768 of SEQ ID NO: 74;
(c) amino acids 2-40 of SEQ ID NO: 75;
(d) amino acids 2-38 of SEQ ID NO: 76;
(e) SEQ ID NO: 168; or
(f) SEQ ID NO: 169.

37. The method of claim 19, wherein the lentivirus-binding domain comprises amino acids 2-860 of SEQ ID NO: 73.

38. The method of claim 19, wherein the lentivirus-binding domain comprises amino acids 2-768 of SEQ ID NO: 74.

39. The method of claim 19, wherein the lentivirus-binding domain comprises the amino acid sequence of SEQ ID NO: 168.

40. The method of claim 19, wherein the lentivirus-binding domain comprises the amino acid sequence of SEQ ID NO: 169.

* * * * *